United States Patent 11,203,620 (CONSTITUTIVE YEAST LLP PROMOTOR-BASED EXPRESSION SYSTEMS) - sequence listing, part 4

SEQ ID NO: 114 - DNA, 565348 bp, Pichia pastoris
cacaacggttcctggctcagttccggtcggtggaactgtgtaagtggtttcataagtgccggtccatggtttgggtagtagtcacataggtcaccggagtctcgatcacaacggttcctggctcagttccggtcggtggaactgtgtaagtggtttcataagtgccggtccatggttgggttgtggtcacgtacgtttcacagtcatctcctggacagcagacattttcacactcacaaacgtctctccttctaagtgggtctgatgttggcactgctccacaacaaactgcttcacaatcagtaatttcgggagtctcgatcacaacagttcctggctcagtacccgaaggcggaaccgtgtaggtggtctcgtaagtgcctgtccatggttgggttgtggtcacgtacgtttcacagtcatctcctggacagcagacattttcacactcacagacgtctctccttttaagtgggtctgatgttggcactgctccacaacaaactgcctcacaatcaataatctctcgtttagcatttaaaccggggtcaaattgatcatttccaataagtttgtactcataaggagcttcacctatcacagctctctctgttcctgttggcgttacagtccttaatgcttcaagtgtactagtccagtacgtagtatggctggaccattccgtttttttagggacttctgcaagaacagaaaacaactgtagcagaaccgaaagcagaatcgtaagttttgtcattgcaaatacagcgagttgacaagggatgagggcaaagatataagtatcggaattctggatgctaagatgtaatgttggagaaacttggcaatttgaaatgcaggaaagttccaagtttagtgatagtcagctgtcaaaatactattcgtctttatttacggcacatcagcgtgtttgaccttcgttagaacgagatccacccgtcacaatctgttctcattcgggctgtgagacctgtcaaagtgtttttgggtctatctttgtactctatcatggactaagccatagcactagtcgaatggatccaaattgaggttgttttttttccattttttcttcggatcttgattccatatggcattatctttcttgaagtgcatgatgcaggtgacgttcgcttctagctggttgcaaaaattggcacaaagcaattattcgataataccgtgtacagtaagagatcacaacaatacgtatttggaaatagatccctctatacctccttgaattgcctaatcgagactaaaaggtttgtccggttagcggcgataagcgaggactcgctaaatgttagattgcctgacgtgacatcttgcatatacgtcaacaaacatgcataatctgtactcttattggccacaacggtgcatgaaagtagaaatatggggccttacttttattcagtcttgggagagtcagcaaaattctgcttttttcacgtcaacagatgcataactagataatatttctggctaatttgctcatccgtatagtgaaaccagacttcactgggctagtcaacgatgcacgtctatagcgaaccttgctgactgatcgaactacggcttcattagcttcccctctactttcccccgtattgaagccagtgcccagcaatggttgaatcaaaacaagaaaacatattgctcctattttattttcttcgttgtgattcgccttataaattggggcacttctggtcggtgggagatgtagttgcggtgcacattctgtcatgtttctctggaaacagattacgtccaatgtgtatcatatgcagacatagtggttatgctactgcaagaactattctgtaggaaaataggcgtgcccaatactgattctgtttcttggtaaaggcagggacacattatgtgggcaggaagttcaattgtgttactgaaacactgttgggattagacttgaatgctacgaaacctcaatccttctggactctccaagagatgcaattcaaatgcagtcacagtatctatattccaaattgaagttggaccattttgataccaggtactgcaaggttttattaggaaaaagccggttacgattgcaatatatgaacaggataaggcgcatgcagaagcggcgctcgagcagggtgcaggacaaccagtcccaaagagtagagagaattgggtcttggcaatccatggaacatcacttcattcgttccagaacgttcaacctgtatctgtttcaattagttggatgccggcctagcaattccgtagtctcaggcacaattccgctcacgccggaaagactgatgtccataattgattctgtcgtacgtctgtccttagacaggaagtgtacagcgcacacggcaaagctaaactacacaccgacagtataatccattacaacatggaatggcactctttctgacatcttcataccatcagttgtgagtcctcatcacaatgatcaagaaaaacagttaaatgctcctttcagagtgtagcaacaactgtgccttctcattcatctcaaagcacttgtgtaaacatgaatccaagagaaaattcaacatcccactacgcagaacaagtagcttctatggacagccgtgggtggcatttcaagtgttacagcactgaagcccaagttcactacgcgacttttgcttctgctttgcgtgtcgccctgggatttcttagcctgattctatactctctggtatgtacagtcgaacacccatcacctgaaatagtattcagaagtgaagactcagggttcagcagtagcgagatgcttttcagatgttattatacgtcccatcaaataacctccaaactccgactcaagttaacgccaccgcacacaaaaatacaaccaaccatccatcaaccatacttcccttactgccttcttcgaaaaatctccacccatgtatgcacaccttccctcacttttccatgctagctgtgcgctggaaccaaccttcaacagtttttcccgctcaaagtccgttaccagggtatttttcaatgtgcctgcgttgaacacgttaatcccaagccgaagttgattatatacatccagcgtgggcctacattccacttttagtcctttctggatgttttctttgggtaactcatcctccaaagtacagtgattacttaaacaatgtcgcgaaaactacatctcaaaccagccatctctgttctagtgcatgagctgctaactagttatcagggataccaagccatttgccgccaaatgctctcaaaagctagttcacacttgtttcagcaactattgtctgcataatcgttcttcaacctcgatcgtcgcagaatttcatggctggtgggatttcacttacagtcagagtttatattgtacacttcgaccctgtcaaaagaattggagttactcaagtttgaacacacaccaagggatctgaaattcaggtggtgagggatagatacaaagcaagttcacattgacttctaaccctggcacgcacccactcaatccattgcatctcttcaattagcatcgagtccatttttttttgcatgtccattctcttggagaggacgattttcaattagcataagcacatcgaaccattactagtcacttcacagttgacgtccattcatttttcattttgcgtttaattgttctttatttgcttgttatattctctttcaatgtcatcttcaactcgaaatgagagattggaaagacttaatgtcaagagagtcagagataagaaaaatttggacagccctcgtcccatcaaacgttcttccagtgatactcttcgaactcggaaatatgactatttcaaaactctttcaccaccgccgtctatccaaagaaagacttccagatctttttcgaacctttttcatagattcaaaaaccccagccgttcttcctcctgttccaaaaaccaagatctacgattgttaactcccagcacagttgtttccaccccagactcactattttcgtgcgataatggggatgattattcgactcccacttctccgctggcttcaaaacagttcactttctattattcagacagtgcttcttcttctagttcgtctgtcaatgaggaattctctaaacttactttaaaaaactgtgtcactacagatcccgttaaacgttctttgtcatcacgaatctttgaaatcccagaaattcttaatcttattctttcctgcctggacgacagcgagagtagaatcccaagggaaaagataaaaaatcgcagaaagccgctctccttacgacatgccaagctggttcatggcgagaaaggtgaccgcatatggagagacagtcaggagatggggttttttgagccaacggtgaaggaatctaacttatacaattgtctctttgtcaacaaactctggtatcagtcaacgttggaaatattagaaacaagattttattttgcagatgagcgaaagcttagatctttatgtgagagaccagtgataaagaagacgaactctcagactaacaccttggttttgcacaaactgttttatactgaacaatatgtggtagaccatcttgcacaacaaatatctggatgtttggaatggctcgagttctatgtctgccctaggatcgtaccttccccaacttttttcgaaggaaacaaaatccagaagctttgcattccaggatctgcagtagttgacgattcgttcttgaaaagcgtaagcaagaaccttcccaatttaaaagttcttgatattagagcctgtgaactggtgacagatgctggagtttattacattgcccacagttgcctaaacttagaaacgttgaacgttggaaggcactccagaggggaactaatcacagatgcaagcatcgggcctgttgtcagaaacaccaaaatcaccactctaggcgttgccggctgcaacatcacagaccgatctctgtggcagctgtgtctaaatcgtggctctcaagtgaaacgactctctctgaacaactgtagaatgttgacagataactcattatgcaagattttgcaccatgattattttcccaacttaacagtgttggagattcgtaactgtctcaacttgtccaacctgaggcccgtagtcttgttcaagaaacgtcagattaagaagggaatcccagtgctggtggagggctgcgaagttatagaccacagattgcgggagcaagaactacagatcgatcttgaagtgtcaagaaaaatcatatcggatataagtggttggataaacgagtctgctgatgatgataatgatttccaacagctactaagaagccgttgactcaacacataatgctaaagaaatgctacacccttgataaatatatagttcccacaaaacattaatataattcataatttatataatagaccagagttcgcgatcacctagactgaaagtttcatcaatcagtcttttcctctgctgtcaaccataggcaaacaacgaatgggcggaagatatcctccaagggagtacagcagaccaaatagctatagaggacctcgaagtggaccaccgcatccacgaccgtcctcgagggaaggtcatggttaccccaaccgtaactcatatcgacaagattatcgtcataggccagattatcgacaggactacaggcatgattatagagatgattacagggatgattacagggatgattacagggacgattaccgggattacgggtatggtcaagagcccagaaatgattacagacatgattataggaacggctccaggaatgattacccagactctcgaagagagaacgctcattcacgcccacaaacggtagaaccacggaggcaagaggaacaaagtcacacaacacaagaaacgaacgaaacaggaaaagagacagaaataacacaggaaaaggaaacggcacaggaaaacaagtcttattgggtagctcgattgaaaattgacggacagcttagagagaagattcaaacttcctttgaaagtttggagagcaccgacgaccgaacccggaatcttttacaaaaatctttagctctagaaatagaagctgataaccttgcaagatttgttgagaatgaagctctcagagtgaagctctgcgaagagaaactggagaatataaattatttgtagtatagccccataatataatgcaagcaagcgcgccttagtcggtaagccttccaagctggacaattctttcctctttcattaaacatgactttagcactggaattcgaatcaaagactgtaaccgcactggtatacctttcggtcttcactggtgcctacaagataatcacagttgtgctaggatatctttctgttttgttggatgtcttcgttctacccggtgtcagtttgaataagtacggggctaaaaagggccattgggccgttgtcaccggggcttctgacggtattggaaaagaatacactcttcagctcgctaaacgtggcttcaatgtggttttggtgagtcgtactttgtcaaagttggaatctgttcaaaccgaggttcaatccaaatacaatgtggaaaccaaactagtatcctttgatgcttctctagattcagaggaaagttatcaagaactggctgatgccattgctggcctccccgtgactgtattggtcaacaatgttgggcaatcccattctatccctgttccattcttagaaacccccatcaaagagctaaaagatatcataaccatcaacaacactgctacactgcgtattactcaaattgttgctccagtcattgttactaccgctcgtcagaagaaaacgcgtggactaatcctcaccatgggatcatttggcggattgttgccaactccccttttggccacttactccgggtccaaggcgtttttacagtcttggagttcagctctagccggtgaactaaaatccgataacgtggatgttgagctggttatttcttacctggtcacctctgccatgtccaagatcagacgaacctctgcatccattccatctccaaaggcatttgttgcttccgtgttcaaatcactaggtcgccgtgggggtgcccaagagcgatacgccacttctaccccattttggtcgcatgctttgatgcattggtggatcgaaaatactgttggtgtttactctgccgtcgccaacacactgaatttgaacatgcaccagagcatccgagctcgtgcattgaagaaggctgccagcaagaaggagtaaagccaatttacacttcaaaaactacacggatattaggacgcccttattgaactccataccagtcgtatttactccgaattccacttttgttccccttgcatctgcgttttaccgttccagtctttactcttgcttactcaaacaataacacccatcacgtagatctcgcgttttcaaatcaaacaaccctcgttttttctcccgtattttgttttcgaactccatcacaatctgcacacaatgggggaattagctgactatcaaagactggagaagatcggagagggtacctacggtgtcgtttataaagcgctcgatataagacacaataaccgggtggtagcgctgaaaaaaatcagattagagtccgaggacgaaggtgtgccttccaccgccatcagagagatctccctgttgaaagaactgaaagatgacaatatcgtccgattgtatgacatagtccattctgactcgcataagctgtatctagtgtttgaatttttggatttggacttcaaaaaatacatggaatcgattccacagggtgcagggttgggagctgccatggtaaagcgattcatgattcaattgatccgaggaatcttgtactgccactcgcacaggatcttgcatagagaccttaagcctcagaatctacttattgataaagagggtaacttgaagttggcagatttcggtcttgccagagcatttggtgtgcccttgcgtgcctacacacatgaagttgttacactttggtacagagccccagagatcttactaggaggcaaacagtattctacaggagtggatatgtggtctattggatgtatctttgcagagatggtcaacagaaagccattgttcgcaggagattcagaaattgaccagatattccgaatcttcagggtgttgggaactcccaacgaggaaaactggcccgaagtcaattacctccctgacttcaagcccacatttcccaaatggggtagaaagagcttagcttcggtcgttacttcgttggacgctgacggtattgaccttttagagcgcttgcttgtctacgacccggccggccgaatctccgccaagcgtgctcttcagcactcctacttctttgatgatgcaatcactgctccgcttaccgatgctgatcacgagctacaccaatccaacatgcaagtggacacttcagcagtgtatacttgaattgttatgccaactacaagaaagaaaaaataaagttacgtaagttacccgtgatattatatatagtttcatattttataaaacagctataattataattatactccttgtcgcttctctcacatcatggcacgtgagcatgtatatcttgcaaacaccgtagacgatagagatgccacacttttcaggtctggttatcctttttttttttttaaataggaagatcttagcccaagaggattcttctatattcgttcaccggagatgccttccatttcacagcgtggttcacgtaacaattcgtttagttcggaaactacggttccatcgctcgctgaggcctctgctgtctcgccctttggtctccccactgacccagaatcgctgtacggaacgaccctgacatcggcccacactgtgatcactactgtgccttattatttgtcagatagattgtttagttatgcagctcctggtgcggatggtgccttagatgctgctgctcatctgtggaggacatatttaagacctaacgctcaaggaaatgtgcctcatttaaccagatttgatatcagatctggtgcttccaatgccattttgggttatctgtcagggctagagccttccgctgtggtgcctgttttagttcctggcgctgctttgacttatatgcgccctgttctggctgagcgtagggactcacctgtaccagtcgctttcaatgtttctgcattggattatgattttgaaacctctaccctggtgtccaactatgttgaaccattgaatgctgcccgttatttgggttactctgtgttcactccattgagcaaaaacgaggctcaaagcatcgccattttaactcatgcgctggccaacattgagccaaccctcaatttgtacgatggcccttcttacctcaaacaatctggaaaaatcgaaggcatattaactggtgaaaagctgttccagctttaccagaaactgctagctgagatcccttcttggtcgaaaatagagtcctacaagagacctgctgctgctttagcctccttgagcaaactcaccggttctagactgaaatctttcgaatacgccggccacaattcaccttcgaccgtttttgttatccatggatcagtagaatctgaacttttgttgcacactgtagaacgctttgctgagaaagacgtccaaattggcgctattgcagttagagttccgctccccttcaatattgacgagtttgcttcttcttttccatcttctaccagaagaattgtcgtcattggccaggttcaaagctcttcttcttcttctttaaagaaagatgtcgctgcctctttgttctggaaactcggtgcttctgctccagctgtcgcagagtttgtctatgagccaagcttcaattggagtagcgattccttggagtcgattattgcctcttatgaagtccttccaaaatcaacctcagccaccaaaggagactacattttctggaccgctgacaatggtcgttttgcggaagttgcttccaagattgcctattccttttcacttagggatgacaacaagctaagttacagagcaaaatttgacaatatcaatggtgcgggcgtactgcaggctcaactaagaactaattctcttgttgccaccgatattgatgcggcagacattgtcttcgtagagggtttcaagttgttgcaagccttcgatgtggtttcaaccgccaaagaaggtgctacgttaattattgcatcttcagactcaattgaagatttggacaaggttgtagagtcatttcccactactttcaaacgtgatgctgctacaaagaatttgaagattcttctcatcgacttggcatctgttggtgagcaggaaggtcttggtgctagaacgggaccaattgcttgccaggctattttttatagggttgctcaacctgagttggctgaccagctgactcgttacttgtgggaaggagcagcctctgagactgaattattggcttcagttgttgctgaagttatttccaaagttgaagaagttggtatcaaggaactttccgtcgataaagaatgggcctctcttccaacaggggaagaagaagaagtcattttaccccctagaccgcttgaaacttcatttgagcccaatcttagggaatctgcaattgtccctcctccagccatcagttccaagctcgaactctcaaagaaactcgttttcaaggagagttatggtttgactaacagcctaagacctgacttacccgttaggaattttatcgtcaaagtcaaggaaaacagacgtctgacccccgacgattactcacgtaatattttccatattgagttcgatgtctctggtaccggattgacttatgacattggagaagcgcttggaattcatggtcgtaacgaccctgcactggtcgaagagttcatccaatggtatggtctcaatggtgaagaccttatcgatgttccttctagagatgatcctaacacattagaaacccggaccatcttccagagtttggtggaaaacattgatttgtttggaaaaccacctaaacgtttctacgaggcattggctccattcgctcttgacagcagtgaaaaagctaaattggagaaattggcttctcctgaaggagctccgctgcttaaggcttatcaagaggacgaattttactcttttgcggacattttggaactgttcccatctgccaaaccaactgccagcgatttggttcagattgtctctccgctgaagagacgtgaatactccattgcttcctctcagaagatgcatcctaatgaggtccatctgctcattgttgttgtcgattggattgacaaaagaggtcgtcaaagatttggacagtgctcccattacctttctgaacttagtgttgggtctgaactggttgtcagtgttaaaccttcggtcatgaagctgccaccattgtctacccagcctattgttatggctggtctgggtacaggattagccccattcaaggctttcgtcgaagagaaaatctggcagaagcaacaaggaatggagattggtgaagtttatctgtatttgggtgctcgtcaccgtaaagaggaatacctgtatggagaattgtgggaagcttacatggacgccggaattgtcacacatgtaggagctgctttctccagagaccagcctcacaagatttacattcaagatcgtattagagagaacttgaaagagttgacctctgccatcgctgacaagaatggttctttctacctatgtggtccaacttggccagttccggacattacggcctgtttgcaagatatcatcgaaagtgatgctgctagacgtggagtcaaggttgacgctgaccatgagattgaggagatgaaggaatccggtcgttacatcttagaggtttattagagaattatgtaatctcaagcattaatttcagtagatccccgcggccttttccgcggcaaactgtatattccccacccatcgtgcgataacagagcgataagcacaactgctagtatttataagtgatagctttcccatggtctttagtctttgacatgaacttgtgatgctgtctggatgtgtgatttcggagattcaccaacaggaatacgctaataatgagtccgagatctacttggataacgcaggaatgcccatgtttgccaaatcagtgctggctgaatcaatgcaaatgatgatgttgggtccttggggcaatccacattcacagtctttggcttctcagagatcacaggcgatgatcgataagacaagattggatgttttgaattggtttggcgttaaagctgagcatttcggagtgtgctttaccttgaacagcacccatgctgtgaaattgctatctgaggtgttttcagacaaattccctgaattcaaatacttttatgagagaaactcccacacgtctttaattggtgttagagagcattctggtgagagtcaagtgtttgatctagacatcgaaacacccttggcagtctctgatgcccccactctggtgtcgtggtctggccaatctaacttcaacggtcaaaagtttccaaccaacctacctttgagaaactcaggcgatgcttgttttagacttttggatgctagttcactggcaggatctaatactgtgaatctgtccgaatctaatgctgatttcatcgccgtatcattttacaaaattttcggctgcccagatatgggagctcttatctataagaaagatcgaatggcacagattgctagatcgaagagatactttggaggaggaactgttgatgctttgaatttggatggcttcgtcaaaagaaaagaagacctaactttgttattagaagatggtaccatcccagttcattccatcattcaacttcagtgcgctatgaatgtgcatcacaggttgtttggaagtatgaatcaggtatcatggtacttgaaaactctgacagaatatgctgtgaacaggttaacaagtttgaaatattcaaatcgtaggccacaggtaatattgtacagatctggattgaatgagtatggaccaattctgtcattttctttattgagtgagtctggtagagttttaggttactatgattttgacaaattcgtctcagcaagaggaattgcccttcgtacgggaaccttatgcaatattggaggagtttccaaatttttgaaccagtctaacgaacaaatcgtaaagaactcaaatttagggcataaatgtggcgattcaatggatgttatcaacggaaatgcaacaggtgttgtaaggataagttttggaatgtgcaattcctttcagcacattgactttttgacggagtgtatttcagactttttgagtgattcattggcaatagaagcaactctggcgcatgaaaaagttccatgtacaatagaacagataacaatctatcctatcaaatcatgccctggttttgatgtgcctagacatacagcatggaatgtgacatctacaggactggagtttgataggcagttttgtttgattaatttaatgacgaacacagttatgcaattgaagtcatttcccaagatggtgaagctactacctatactggacagagaaaacatggttttgcggttcaagaacgatccgaccattcaagtgtcattgcacgacgataggaaacacagtacaaaaaaaattgaaagtgggggcaaagcctatgaatgtatcatggataaagcaattttagactttttgtacgatacagtgaagactgagtgctgcctggcaaggctggtacctacaaaagtgaacacaagtctccaaaataaatcagctttccttttcatcagtgcacccagtctggaagaagttgagagaacccatggaggtggtcttttacgatcacgattcagagccaactttttggtgaaaggcaagatgctgtctccctttatcgaggatacctggagtaggatagaaatacccgaaagaagaatggatctaacagtaactgagaaatgtggccgatgtcatatgatcaccatcgatgattctggagggagagattttggactcttcaaggagctgagtcaaacgagaaaacagcaaggaaaaatctactttggaatcaacgttgatatggccgactcaaaagccggaactgtactcgtcggggatgaaatcttaggggtgccataacataaaagttcatatacatacatactaatactaattcagagcacgcgcgcgcatcttaaataatatttggggatctctgctaggggaccgcacgattttcctctacagctcgttatccactatgagtcaagaagagctagacagagtgtcggatatgttggtaggtccgctaccgtttaaaaaccccaactggcaccggaaaaagaagtataagccggctagacagttaatcaatgatgaacagaagcgcatcaactcgaaagagaacagaacgtttgatgaggttaactactttacagtccaggcacctccttctttgaagccacgaaagacgtattgcgacataacggggctccctaccagctaccgtgctcctcatagccagataagattctacaacatggaggtttacgaggtggtgaaaaatatggcctctggtgtagatcaacagtaccttgggttgagaggagcaaatgtcgttctgcggtgaaagggtatatattatgttatgttaatgcaaaaattaagtacttttggtgttccaattctccactattgttttaatggtggagtcaaatttgggtgtattaatcatcaaatcctgtttatctatcgactggaaaggattgaatatcacccggagataagatctgtgaatctgagcaaacaatggatccagtctctctgaaatatctatcttggaatctgttcccaccactatcttcagcccagtgcttgtgaggagtccaaagactgaaaccccgtcttccacgaacaactggctgcatctattgttctcctgtggttcgaaaaaaggcgattcaaaaatgtccagagccatgtgagataaaaagttgtatttcaatagctcattggtgtttctctcttcaataaaggagggtggaggttcaactgacgagtctttcaacttcaaatgttttacagactccaactcatgttccaatggtgaaaatggctgcatatacaaaggccgattctattctcagttagctatgagacagttagacaataacgctttctacttacatccctggcgatcagggcgacaaacagtaccctctggtcagacatttgaggatggttataggaaagcaagtcgcaggattcaggtcttgtgcgcgcacacttcagataaccactaactttttagactaagtgtatataataattaaatgactctataccgctggctcgtctccgtctgaaatgtagacatcaggattgtcattgtttctataaagccaaaactggaaaaaaactaaaggaatcctcaaatatagttccgaaggaacctaacagccaacttaggttcaggatgacgtattcccagtcgcttctgtataggacgatttgcaacgagtaggtcaggtttcccacagtggaaaagatgaaaaataacaaactcaaacccttgcatgatttcttgacgtaattttggtagatttgaggcaatcttgccgtgaggtagagagtagcagatatgtaacccaaaatttgtggtcctagtcgaatcttctcatgaggaagatcatctccgtcacccggtgtatgatgtgttgtctcaccggagaagaaatagccagatgcaccagccaagagcacaaacaaaactggaagaactatgttggtgaatatgtgttttctgttgtcacttagaacctgaacctcgatggatgagcgtcttcttgaccttgaagaatgacgacggttgacgagtgcactggtctcatcaatggtaatcgagcctgaacgatgagagtgcgtgctattaagatgaagatgatgatgacgatggtgttttggatagatgtaggtgtagtagtaataagagaaaccaatgaggaaatcagctaagcaataccaaattgctagtaggatcacctgaggtaacaagttggcccagagagcaccaattaggttggcaacgtcccccaaaaaccacaaggcgatgaactctatagagattccctctgcactcttatacttccactgttccactagttgcggtaacagtaacacaatccagcatgctaaagacgttgaaccggcaataccggagagagcttcccttaatgtgggggagtccccaccaaacatctccgaaagagcagtaacgcttaacataagcaggggtcggttcaattactgcgatgatatgggaaaggaaagcagctcaacgcgcttaaagtcacacagttgcccgaaatgggagaagatgtcggaggtgattcaccgttcgcgaattttcctaaaaggagtttccagttctgaaaattttttttcactcaaatccacaaccatatcctaagatggccgtaagtatcaaaagctaaaggaagacgctggtgttccctagtcacatgtgactgaggaacatgctcgtctctccaaagtccatccaagaccccgggtagatgggtatgtttttctttgttcacaaggctgagtttcccttatgagaaactttagaggagttctagctgttattagccatgattaataacaaatatatattaacaactccttgatgaccagtccttaaacaatgactctaccgctcctttagcttcgaaaagaaacaacgttgctgtcctggatgattctattgacagcaaccttgttgctccacagaccactgaggttgcccagaaagctgcccaatggcctgctaacgttagactgcaaagacagaagaagatcctgtaccaaagactcaaggttcctccagctatcgctcaattcaccaacactttggacagaaacactgctgctcaaactttcaagttgttcaacaagtacagacctgagacttacgaacagaagcaggagagactcaccagagaggctgctgccatcgctgatggtaagaagaaggaggatgtttcctctaagccttacgttgtcaagttcggtttaaaccatgttgttgctttgattgagaacaaaaagcctaaacttgttttgattgcccatgatgttgaccctattgagcttgttgtctttttgcctgctctgtgtagaaagatgggggttccatatgcgattgtgaagggtaaggccagattgggtactttgattcatagaagcacagctaccgttgccgctttggttgatgtcaagccggaagacgaggctgagttggctcaattggtctctgctatcaacaagaacttcactgagaaatacgaagaatccagaaagaagtggggtggaggtatcttgagtgctgaatcccaggccaaggctgctgccaaagccaagcttctcgaagagaaataacttctgtatagtattaatagtaattgagcattagaaagaggacagtggctagtggggaggctcctgagatcaaatcttcagaatgcgtattggccttcttagacactatgttacaccaaattgtttaatcacgtgcgtttatacagggcgccatcaccacaacaccactttgtcatcctggaaaaaaaatgtaattctcaccactcctgactcaacaccaaaccaccgtaagaagtaagtgaatatcatcagggatctagcgtcatatcgatccaagtcaagaaagcagcattcccaaagaggttacattttgttgcttatcagatccgaatttcaccgctctactccccttcaaggcaaagcccaactaagttactaacaattttcaaagatgtctaagtctaagaaccacacaaaccacaaccagaactacaaggcccaccgtaacggtatcaagaaggtcaagtttgacagatctttgcgtttgaagaacatcgatcctaagttcagaagaaacctgaagttttctcaggttggtaaccgtaaggccgccgctgctaagactgcttagaccaatttaattggatgaatctaaactatatcaagtaatataatcattcaaaaaatatcactgcgagtaaaggatcacccggggagttgaacgtatgagtattgcttgtagtgcgataaattttcaagcggagcgttcattttttgaggtaatctgtattgtttaaacgtagagtcaaatgctgtagatctagttgcgtcgtactcttcaatctgagctttatagttccgcaacaatttttatcatattgtccggacgcccttcctgtcatgtgcgcacgttagttaaacttttcagagccaaaaacgttgatcacgcaccgcataattaaggtttctctagtaaacatatcaaggtggggtcaacgaccctagctataaaggccagcagcgtccacagaatagtaactcggaagattcattatgaagcgcaatgttgaaatgatggaggtccaggtagacggcacccagaaaaaagaacggattcaaagtaccgtctcaatgcccaacttgatgctactccaatccaaatcctacaaggcttataagagcatagatagtctcgcccagccaatgagagatactccattgccattagtaaacagagattacaataacacgttgaacgtgtcggagttgctggacactttgcatgggtcaatttcaatactgttattcttcaatcctattgcatctcgggaatggcttcagtggtttaacgatcattattacaaaattacaacccattatcgtgcccacatcataggagtcactgcatacaccactgaatcggaatggcaatttcctgttataaatgacaataaagccaaaatagcatcgcatttcagccttgctgacccctgcggaggaggagcctatccaatgaatgcactcatagtgtttggtccgactggtaccaacgcgttacagctacacatgcctgctgttcacaatgtggcatatcgagatcgatggaaagacgccaccaacatccagcaaagtgtagtcagttgcttgaactacctagccagcaaacctttaatctaatattcatcattccattgaattggtcttgtggactgattttctatgtcgctttccaaatttaaccaaactttgcttattgatttaccgttactagtttctctctttccgcttcaagctccttgagcctgtctttctgaacattaatttcttctatgaccttgtccatagcctgtttaatccggtccagttcgtcgttctccattttcttactgaacgtgtatttattatttcccacaggaggaagaagtgatcctggtgtctttgtcagtatttcaaacatgcgttctgttggctcattgaacacaatctcatcgtataagatgctctgcacttctctatctttatctgtgagtacatgtcccggagggaaaccgtaaggatgcagttttaggttatgataaagagaaacgtttttctcattgctttcagggacaaaataaatctttatgccaatctcaaattcaccccagcctgtctctgtcacctgaaatggaggagactctatagtcctggtagagtttgggtaggtatcatggagtttaaataccaccttcttgataaaatacgacaggtccttcccttgagggtctttaacaaagacagtccacgtatgcgtatgctcagcatttgcttctggaggccttttctctccaaaaggctttgcaacgttaccgtacacaataggccttgaaatagagacgcccttcaagcgctttcccgtgcttggtgccattgtgagattctgagagtgcgacgaactgtagcctgtttatctagaacgagaagttgagaaagatgtttaggcaaagaagggcgcgagtcttccttctggaaggatgtaatccttctccactacgctatagacaaagtccaaacaaaagagcataacagccatcctttcataatattatggcccttaaaaacattttcattgctagagtaagcttcttttattatccttaaaaacttagccgaacaactaaccgtttagcacgggtttagatcgaattggttgcctcctccgcacccagtaagtcccactggcattgactcagactctccactagcagagcatggtatcgaacaagcccaccaattggcttcctacttagtgtccatagatccgaagccggatatgattttgacatctccattttaccgctgtatcgaaacttctcaacccattgcagagtcattggacatcgacatctgcttggatcgaggtgtaggggaatggtacaagaaagatagacctactattcctcaacctgcctctgtcgatgctttgtcaaaattctttccaaaacggctaaagaccgatattgcggatatcagtggagttgtcccttcagctctaggtgaatcagaagatgaaatattggcaagatgtcaggaattttggagaaactttataccacaactggagaaagtccagcctcaggtagaaaatttgctcattgtaacccatgcagctaccaagattgccttaattatgtctttattaggatacaattcagtaagagataacttgaaaccaaaggatcgagttgactcttacgagacaatccaaactgggtcatgttctttatccaagttgaccctaaacagttcccaatgggaactcaagatgaatggaatgactgattttttgacgaatggcacagaaatgaactggaatttcacaagtggatttgaagctggatcagatgaagatattgccagcagaaaagcagccgcagaaaaagcggaggccaaaaaaaagttggaagaaacttcggatgatgagtatgaagacgtttactttaccttggaactgccttcttccagacattccactcttgcaaatccctttgatgtgccattggctccaaaagcaaggaaaaagcgatcagagccaaagactgaaagaggtgatcaaggaggggaggatgacgactcagaagaaggtaaggaggatcctgacgttgtcttccaaaaacaattggaaacctccttgatgtccaatattgagccaacgtctgtactccagatgtctggactggaaacttcaaaacccttgattcaaatcaatgagtcgattttccaaggtcgctgggtcaaagtaaacggaacagagatgatatatgatgacagtggagagctagttgctaaagtagatgaccgcatccaattgactgctggcaaactaaagagaaaggaggagaatcctgatgttacggcagaccaagaaatgtccgacttgagaatcaagtcagagaagggaacgacatttttgagcgaagtattgaacttggcggatcatgttgatgaagagcatagacagaatgaaagagccgacacgccctgataacaggttacgcgaccgggcaatcagcaaagaactcgctcactctctttttagcatcaatatgacagaaattgcaccattcaatcatcccgtatatgaagccctaaagggtaaacgattcgttcttgcttccacctcgcctagaagattggaaattctcaacagcttgggatttaccgatgtggaaattatagcatccaactttccagaagatctggataagtcacaacacacaccagaaaactatgttctaaatactgcaatcgccaagggaagggatgttttcgaagcaatcaaaaataaaggagagtcggtggatcttattttggcagccgacactgtcgttgaggtgaatggaacactttttgaaaaacctcgcaaccgagaagaacattttaatgctataaaaacttgtcgtgactcacctcatcctgtgcgtgcgattagtggagtcgtactgttaattgtgaagggtgaaggttccagtatgaagtacacacaggaaactttcactgaatccacagagatcatcatggataaggatgctacagatgctatgatagatgcgtatatcaatacaggagaaggttccaaagtagctggcggattcaaaatccaggggttcggagcgctattcatgaaaggagtcattggggattacatgaacgttgtgggactgccattcactagtacattcaggaccatatgtcacggtttggatgtgtcgctttgagtacgttgggtcttcattttcacgtgactcctttacagaaatcaaattttccagtgagaaaaaaaaaatactcttatcgattcttttctgaaaggcatccattaagagatttacaaaatggctaaaaggacctctagaagtaaatcaaatgggtcatcgaaggccaccaaagaggagcattttgagttgccaagctcttctgattcagaaaacgaagatttcaacgaaccagctccaaagaaggctcacagagctcagcagaaaaagggagccaagagtacatcacagaatgaacgaagtcacacagtgcgcaaagatataaagccatctgccgaagaggagaataagcctgaaatttccagcaaaagtgttttatacgttggtaacattccaaatggatttcacgaagtagagatgagaagatacttttctcaatttggagatatcactagactcagactttcaagaaacaagatcactgccaactctaaacattatggatatattgagtttgccacgaaaagggccggtcaggtagctgctgaaaccatgaacaactatctgttgctcggtaaccttctgaaagttgaagttttgccgaaagagaaaatccatccgcaattgttcaagggtgccaaccaaaagtttgtccgtcttccatggaacactattaatcaattggagaatgacagacctaagactcttgaggggtggaaggagtttgaaaaagctgtcaaggccaagcgtgcggagaagcaagctaagctgaaggagttgggcataaactttgatttgaataagctgcttaaatcgactactgcttagttcggcttcaggctggttataggtttaaaatttgtacagtaatagagcaagatcggtagttcctgtagaacagataaaaagaccaattatcaatcagctagagcagacgataagaagtcggaaggatcatatccgataaacgctctgcaatgtcctcagttaatcggaatctttatcaaacccaactgtttcatttggagccaacaattacacaatttctgggtggaacacgcttcccaaactcgtttccttcgtaaaaaaaatcacgatctgccaaaaaaaatcaccctacaaagagtagataacaccgacagtaagacccccatgtctgaagaagaagaactcaaggttttcacattcgaagaagtcgaacaacacaaggccaatgatgactgttggatagtttacaatggtaaggtctacgacgttacctcgtacatagaggaacatcctggtggagaggaagtcatcttggagtgtggtggagctgatgccactgaacctttcgatgacattgggcattctgaagatgctcacgagatactggcaaaattgttgttgggacgggttgaaggtgcacctgttaaggcatccgtgtcttctgccagcactgctgaggactcaggctcttcaaacaacttgctgctggcggtgcttgttgctatattggctggtgttgcatactatttcttcaaccagtagtgcttgtagattagtgtagacttactttggttaataattatttatttattgtataggattgaaaaatttacctaaatcggccgaaatggttacccaagggaggtggcacgcaacggaatgagagagcacagcataagatgagcctaggcgttcaataggtaatagacagcgtgaaacagtgagtcttttattagatcttaatccattcctggctacgttcattccctcgaattgtcaacatcaaattcatgctagtgttcctacaaaactaactactaattcgacaatgagtaatggcaaacggtctttagctgaagttttggacaccgaagaactaaaggtccaagagcagaacgaagaaaacaatttggagtcacaggcggagaatgaagatgaagttgactcgaagttctgtgtcgagtgctcagatatgccgacagagattttttgtgtgtcctgctcggagaatttttgtaaaccatgttttgggatgattcatcgtaaaggaaagagaaaaaaccataagagggaagaagttttacccgattcgaatggagatgctcctcagatctctaatatgtcacaagatatcaccggtagaagtggtttggaaaatgcgaacggttctgagaacgatgaagaagacgaaatcgttcctgactcctctaatccagagaaagaaaacatagagaaagtgatcatgagtggaatcaagaagaacatttcgtacattcctttgcgattaacccatcaagagcgtcagttgctgagattactggaggcttcgttgcacgtttctgagtacactgataaggtagacatactatcgcatacctccaaggccaagcggattgtgtctcagctgaaagaaatgtgctctattcttgctggtctggtcgtcgcgtctgaccttaaattgggacaggaattgattgtggagaaggagtttgcagataacgctgaatggtatcagaaagtttttgaaattggtcgtcggtacaagatcatgaatccagaaaagatgagagacaccttcggtaagttgtgttacatggtgatggattccaagcttccccaaatcgaagaatatttggaatttaacctatacaaaccaatccaaactgtagagagatacctttcttcaagagacgacccccaggtgttcaaaatgtttgacgatgaaagcataatatatgctacggctgagatttctcccggcaacagatcgagatatcaaatcaatagagatatcaaactgaaagagaggtcaatagaaaaaatagcttcaacctactcctcatcaaaagggttcaccaaggaagagattagacaggtgctttattctattggcgacttcaatgcatatactaacgccaatagaaaacctattcttcggatgataactagattgtcgaagtttgaaaacctctccaatgaatactccctgggcattaagtttggccaaggcggagcaagactgtcccataaccatcaaaaacaatatcaatacgtgttccagtcgttacagttatggtcgcacataatgagagaaatgatacatctttggtccttggccgatgatgacctgttctccccacagcaataccacatgcaatctacaggtcagggactacacagagttaaggcctgtcctaaagtttccagagcaatgtataagatattgggtgaatgtgaacgtaaatgcaacggatgggttggctcccaagtggttcataccggagatcgtgatgttccaaatgctttatttttcttggataagtataaccaggttccccaaatcctaataccgatcgaccgttgcatcgacgaattgaatgaagccgtcaaggataagttcatcaagacacacattgaatcccaatttggaagtgtcgaaaagctctgcgatatcatactgaccgatttcttcagacacgcttttgacggttctggagcagacaatttttacgatgctggttcctgcatcgatggtcgtctgacatcagcttggaactttgtccaaaacatctcaaagcgccagtactacaagttcttcatgatggtcggctgcactggtttcaatggtactgaaggctggtgaatttcatatgtatcacgtgatatctctataaaatatgctgaccgctccgtctcacaagtccagataaatccggtgtgttgtttttcttggaaacgaagcaattgacccaaaaagtactctggtggttgatgacacgactgaacagaagctgcggcttaacgctcgtggctctttgcttcgttggtttggtgactgcagacgacgaccatgattcccacatggacatgagcgctcctaaggaattccatccgattaatccaaggtcgaagacattccattggcttttatcgttggctttactgtttatgttaccttctgtatcagcggcttactgctttgccaaccgttatgttgtatcgagcataatgcaaattatttgcgcttgctacgcagtattcgaagtcttagtattatcgtttcccgatagcgatggagtggaaaatagaacctcagtgggcactgggtgggttcttgcaattctctattgtgtcactgtattttttggatcgctgacaaacggaagtgagtttctgctacggaacaaacagagtgaccaatggctgagcgcgttaggacatacagctagtaggcgtgtgtacaagactctttctgtcttcgttgtgcttgtcggttgggtgaaagtttgtttggctcccgtagctttgttcgggttttgcagaggaagaagtaccgggcaatgtatagctcatggaattatggggagctcatttatttggtatgggttcatacttctactagtgcttgtgataccgtggctgcgactaagagagaccggatacagtcaagaattttttgactctctgttgatgactgcctggggttgtgttaataccttcaccgaacatcgctggggccgtgaagcatggtctcatggtgactatcaacacacttccatgggaataatctggtggtgtgggggccttttagggctctggttaactagaaatggggaacgatcttacattcctgcgttacttttaatgttcacgggttatggaatggcagaacatgtgcagaagctacagattagcacgaaagttcattcattttttgggttggctctaatcggcggcggattagccagaatagtggagatttcgtttgttttaagagacaagcgtcatgattcaaaagtccactctttccaatacctcccgtcttttgctttggtagaagcaggtgtacttttcatgggtgccacagaagaacagctccaactggtcaaggatctcggagccgaccattcttcgtacattttggtagtatccggcgctgcttttatgattcagttatggttcttgttaattctggaattatatctgaaacttgctacttcagactttgccagtaacggagagtacacattggctgatgaagagttcgaactttccgacctctcaccagtgaatacacacgaataaaataactacacacgatgatgtaaatatgcagggtatatatatagctgaactgtagaaaatagaagcaaacacagacaaactcgtaggtccttccacggcgattaggaggtgagtcggctccgtctaagtaattttttaggatcccgaggtagctcgaaagtggttatctgtggacttatttcaattatcatcataccaggtggaaccccatctgagaataggtcacaatcacgaggggagaaatgtccaattccaaaagtctgggcattgtatttcaatcttcacgggcaagaaacaattcgggaaatttcctggccgacgatgactcagatgatgccgatacacttgaggcgttgaaaggaaagttgaacaggcttcgactagctagcacacagacaataaataatacgaaattagcagagattgagaagagcatcaaagacatagagagcaaaattgactctctgagccttgatttgtccaatgaatccacagggctcaaaaaaattgatacaaaatcaacacaatcgctagtgttctctccactagacagcaaattcgaagggtcaagtccgacgtttgcaatcagtggtatattacaggagatgggcaatcagaatctagataataaatcgataatagagaatgcgaacgcattggtgtccgtgtttcagatgcacccttatttgaagacagaattgtcgttagctccgtttggaagtaggattcaggcattactattgaaccctcaatcagaggtgattgtatctgcctatagaatatccagatatatcctgctggattcaggtactctggagcttttcaacaacattagactggatttatttctgatcatatctctatccaaagaggctaaaaattccatggagaaatcagaggctctaaagctaatcagagcgatagctgaaattgacaagaatatcatatttatcaatattaacatcataaagtcgttattagccattctagaccacgaagaagatccattttaccccatagtgttggaaactgtctgtgagtttggcttcttgtttcccaagttaatgtacgaggcagattccttcaagtatatcatcaaatcccttatgagtgggacatctgatttctctgagtgttgtctgctgtggcttctggagatgatcgacacgccccgcactaggaaaattgtactttatgactttgacccttcgttattggtggctccttttattgaacatcgagtgaggcttgcggagggaaatcaccgtgttgatctaaaactgcttaatcatacaggttatcttgtgaccacctttttgaaagttttgcccggaatatatattgtgggacaggaagattgcaacttggtgcaaaatcttttagattgcttggatcatagggctgtagacgtctgctcggtgattataaatatcttatctgatgtttttcgactggaagtttatccacatccctcggtatctcataaagaagatcggcaaacaagttatggaattgcgtccgatatcaccaatcatggactagctctacttctgaggctgtttttagataaaggattattatacaagctggattgtttgactgaggatgccacaatttttaagacaagaaaagaactagaactctttaccgcagctaaggatttgatagttgggctattagtgctgggttcaaaccttttgcctgaaaattatgccttgaatgaaatatacaggtcacttgttcctttgggctatactgacatgaaccagttacctgctaagtacgagctattggaggtacagtttagacctgatagaatcggttcgaaaattagtctcaaagatctcaaaattcccaaaacttgtaatcaatgtccactaaaagcggacgatcctttagttttgagacaaaaacttatggacacgaacgtgctgctcgagaaggattacacgaaatgggactggggtttagtgagtcagttgatagaaggcccattgcagaatcccacccgtcttgaagaaactataaagtccaccaagtttttgaaacggataatgtcattttatcgacctttaaaatacaggttctccaagttgaaacgtttagagactaatgaaaaatttcttactattgggtgcaaattaatggaagccctcataaagagtgatgaaggtcttaactatctaagggaatcagacctactaacacaagtgtccgattgcttggcccaggagacaacgttggcctcatcaaaaacttccaactcaatattttcagcaataaagattcgtacatctatgacctatggttatttcagcattataggggtgctgtcaagaacggcaaagtcagtcaagctattgagcgaagttggccttttgcgactttatgatataattacagattcctcagccgaaagggaggatttaacgaagttaattctgaaagaaaatgattaccatatatcacatacaatgcagcagatattgaccaagatagccatcagtgcaactgagaaatttagattattttgcacaaaattgattgttgagcttttgcacacacaggaagaagctcaagagtttttcatagaggttcttatcaaccaaatgtacgatccacaggaaaacattgctaacctggccattcaagaagtggacaattatgccacgagtaaagcacagattgaaaaatttgttgaaactcaaccagaacctagcatattattcaagatgaaagctgattcattgctgaggaaagtattctcaatatccaaaggttacaattatttgcatgacctcggatttattgacgatagtctcaaaaactggattacgaaagagagtctgtcttttgtaggtagagttgaagagattcttaagcacgatcttttcattgattcatactcttctactaagagcaagaagatcctatatacgaaagttccatttcatctttatggtgagatggtcagaacagaagaaggtgctctgaaactgaagaattcgggagtggtcaggaactgcactgactttgtccaaaaatttcgatgggaaaagatagatgaatgtgatcctgatttattaacactattgaagtcctctctgtggtcaattggcttcatttgcagtcatcatttgggatttagattactccaaagtagcaacatcgtggaagacataataaaacgagcagagacgtgcactcaaataaatgtcaaaggtgtttgcttttatgttttggggctgatagcacgtaccaaggaaggtgccgagattctcgatgatgaaggatgggaaagtgtatttgataaagttaacggtctcccgattggaatttgtctacccacagacttgtcgaaattttttgtcacggaagaagttgagcactacagaaaacgctctaatacactgatacatgaagatttgttaagcttttggagcggatccagtttgcaacctgaaaacatgatagtaatatctgaaatctgcaaaaacttgatcaatatcatattgtaccctcaaaaatcaatcaatcagttgaataaaataaaatcacgatatagtgaactgtttgatacggatcccaatttgctgttgattgtgatggcactatttgcacaatacaattacgggctcagagctcgaaggttcatccttcaggaattgttcaaagctcaagaattagcgggaatgtgtgctaagaggagtagaaagaagctgaaggaaaaggaaaagctatatcgaactccacccccattatcataaaccattattataagcgtaaaaatgtacataggcctttttaatgattattcttttacttttttaatctcaatgtcttcttctggctccagttttcttttcttagaaacaggatcttcttgaaagatctgaggattagtcatctttaaatagtgggtgtttgtgagaggagtctgttcagcgatgtctagtgcagggactttcagccctgatgtgtcgacggtataaccagttatatccgtctctttcacctcatcttgctccttatagttacgggggagcatcttgatatctttcattagcttcactaccattttgttcttgattcttgccaaatattgatcttgttccagggtagcgtccggattgaatgtgttgacgggtgagagtttgaattggatctccatcaaactgtccagtgtggaatcttgatgatccacttcatcatccaataacgattccaacattttcaactctggtttcttttccaagatggattctattatttgtttctctgtatcttcaatatcatcttggtcttcgtcttgagggtacacttctctgattatgtccagaatggcagcatttctcagggtattgtatcggagaaagtgtctcagttcggcttcagtttcaacgttctctttgaactccttttccgttttgtggtatttgtctagcaagaagttgtagagaactctatactcagctgccgttcgttgtgtcatctgaggaggcaggaggaataaagatgctggtgaaatttggcgcggtctaggaagaacgagagattgggtagccctcaactagaaggcaagctgagatctgagaaggtgaaattttatgctttgcactgtccatgaaaaaagttatacaaatcattgtcaatcccatctcatcacagagggatctgttgaataagcactgtatgtctatatttacaaaacttttatatacatgatagttagactactgtgctaccgatctcccaaataagagttgatgctgttctgtatttcttggaccgtttcatcctccggtaacttcttcagctcttgctccttatcatgcccacccagagcctgtttaagtttgaaactgaactcggcaacgcttgatatgtcataataccatagaacccctgtagaggccattcctaaggaagtaatagctaaggaggtcgaatggaatactgcactaagggcatctctgtagaatgaaaatggtggagcaacatggttgtgctggtaataatttggaacgtatcttcttttgataacgcctctgtatgcaatcttggagcagatgaacgtggccactgtgaacccgtagaaaagagccatttgcttgaaccgtctttcattatattgtttaacttctttactaacaagttctgggtcttttcgaccgaacatcttggagaaatcaaatccgttgaccatgctgtaaagagtaagatttggagtcaggagtggagaatttgtgagattgactctcaaagttgaaagaatggatattcgagggaaaagttgatctaagatgcctgatgggacgaaaaagatcaagagtattctcatgcccacacaggagatatctgaggttgtcattcataatagtgttgcgtttcatcagtgggtaataattcactgctagctctttcatttatctgtttgggttgccaatcccattgtctattcaccagctttctgtaccctgctcacgcgtttgtcggatcgcaccatctgaagaccaatcagttcatgttggagaaaggaacccaatctcttgtgaatcggactattaagctaagagtcttagggggtttgaccaagaaacttgcagcgccgcaaaatgaatcacttccagagcttaagcctcaattagatgtctatcagaagttcctggagaatcttagagccttccctacaaagaacaagtctgtccctaattcgcctatacgctactcgtattacaagattgctaacaaagagtcagaagctgttaataggaacttgctagagttgttcgcttcgaaaaagtatttgccattccttgcttcagaaattccaaaattgcctccaccttatgttgctgcagctgcaccgatgaatcctaaaatttcagttactcagttgctgacagattcctggtgtgaactaagatcttattacgactcgtatgcttgttccagggcagcgcccagtgctgctatggtctctgggactgaacagcataagtctctggaagatagaactcacaaacctgaaattaatgtcaccaaagagattcaaaaaaatttcaccccaatcatgatggaccagttgaaaaatttcgaacgtacgttgaatctgataagcaggtttatagatttacttaccattggaaaggccagggagtttgcagtgactgcgataatcaataaagaaaccaaagagttgattgacgtgaataatctgcaaaaattggcgtttgtccaccaaaaatctccttgctataatgatcagtttattttggcttctggctacttggattacctgagaagtgaatcgtacgtcaatggtctggagaaggaaaagtggattcaaaacaactactctttgaacacgttattagaaacttcgataaagggaccacttacggttattgacgttaaaactagaggtaaaccgattgtgacaaagtcaaaaggtgtactgatcggtcatcgataccaaatcggtctttatcgtaaatttctagggctaatgagtggggagaacgtcagtggaatcaattccccaatttcagtcgatcaaattaatgaaacggcctacaccttattggttacggattcagttcaaagaggctatgatgtcgatgagcctgttgatccagtagtagggctcgtcatgctagcaaacaatccttggatcattacaatgcttgaacagatctgtgtcaacgatttgcttggtaactcgttgtatgacacatttcatgcccaacaatccacggattactcgtgggatttgtctcaagtcaatcccaaagacttttatcaggttcttgagccgtcacttcttcagagaaccgaacaattattcaccaaatggaaacgtcctctgtctctccgttcaataacagcattaatcagcaaattttatcccctcatatcaaaaaagctctcccaaaataccaaaatcatgtactataccgacggagagtgttttcacacctccaattatttatacaaccccaaagcaattaataccttcatggaggataaagtcaagttcctaattggccagaggcctcctcggccgatagaaaagtcagaaataccccaaaaatgtggattctgccggtttcaatccatttgcgaatactctaatctttacaaccccgtcacatagccaagtttattcctataatcttatataaatctgtgcaccatgtatgtcaaattgtgttcattacatatcctccatattccttaccgcgttcgtttaaccccagcattcttcactacgccagatgccaggcgttgtccaaacttattctttccatgttcgatagccttaagatttatctcctcccgttgttcctgcaaatcggtagagtcattgttcttctcagacataaatatgttatcaaagctttccggtccaagattgacctcatcagtccttctgaatattaatggaggtcgtaacaaatgtcggaatctaatagcattactccgcctaagctctgctggctcctggagcctttgtacaaatattgagttatcgtgcaagtaagcgaagctcatgatatctgtcatttgattcctcaccggaggactttgttcagggatgtttgctggtgattcgttggacgtattggagttattggcggtaatggggttgttggagtatggcagcacataatctccactttctgatatccgaacccgtttcgtccgatgctgggtcgcatcgtcactatcgctgtctgaattatctaaccgaagacccatgttttgtgtagagcataattgaatggtggtttgttgtgtgtttgaattgctgtaaccctaagtaaagtttctctctctgcatcaaaactttactatcgaccaccccactgcgaaaagataagtggtagtgtaccgaccgaggttcatcagatgaagtttcgttggcccttggggtttcctttcttctttacaaaccagctttctattcactgcaccttcccttcaatggaggagtggaggggaaaaggaagcaagattaacatcagaagatcactaaaactgagacttgtgctgatactcaaagcaggattcggtctttatgtcttttgagatatcatgacttttcgactagaatgtcatcttgctaggtatagttccgtgtgttcttctttttcttttctctattagattgtcagccttttctctcgtctttcgccgctacgtccgtttttatctcattcttttattgccggtacacagtacccattattatataatacaaagtaaatcaacgacacacggctatatcatcataattgctcccagtacaccagcaacgaatcctgatccgagtggaactaggttggctctagctgcattaacagtgttcacaataatttgtggggtagttgatggcgtatcggttgaaacaacgacaatacctggagtagtgaaagatctatgcgtggtgaaagtaactggagtactggaaacagaggagacataaacaactgtggatacctttggagtctcaatgtactcaacggtcttggaagaaggaaccacgtcaatggttgtctctgggacaactggcttactagtttcagtggttttggtctttggtggctcaggagttttggttgtctcagtctctgggcaaattgtagtaacaacggtttcaactccatgtatcttggtggtgtacgtagtcttggatactttggaagtctccggagtcttagtagtctcagtctcgcaaggaatgaacgaagtaagggtcaccaacttactgttgacagtactgacaatctttgaagcaatgtacttggaagttacaggcttacacttgtcgctctcgcaggttgtcgtagtcaaagtgacggtggatggagcagcttttgattcagtggtggtctcacatgggatgaacgaagtcaaagtaaccaaattaccactaacagtagaaacaacttcagtggaaataaactcaccagttaccacagaacacttgtcctctttgcatgaggttgtggtcaaagtgacagttgattgttcagtcacgggaacggtggtagcatgaggagcaggggtggaagtctgctttggacgataacgagtcaaggtaacctccctaccattgacagtggtagtgtatagttctccaattatttcggtggttaatgtagaacagccggcaaggttgcagctggtagtcaaataagtactggttgtgaatccagactctgggtgctctgtgacaactggggcgatgccaccaaggccagatgaagacgagccacttgaagacaaggcagtaatcgtgctggcactggtctcagtaactgtgacatctgtagtacatgactcacaaacggtggactctgtaagggagttagggttggcactgatcaagttagtggaagaagtgttggtgaaatggaactcggaagttgccaaagaaagtattggcagcaaggccacgctaatcaaagtagtgaacttcattttatttgtgatgtgggtcagtcaagtgattagcaattggccctcacaaggaggacaaacatggtttatatagcattgggttcatgtggttcctatttgcatggctggctgggcttgccatgcgtagatctggtatcgcgatctggttttttttatgctgacagaaaaatggctggtaaatgatctatttttgtgcgatgttttgtcaaaaggggtagtagcgttttgattacttatgaaattgcctattgtgcatgagtacaatcccctttatctatgcattttggtagatggcatgcttgatagagaggtactaataagtaacaggcaagtttggtagtcttcgggtgagtttcttttgacaaaatgtcactaaaaaggatctacaaatagccctatttcattttgcaacatcaatagcaacattaagggccttgttgtatttactcttcttcgattatgcaacgaaatcttttaagtttggatggaatagacttgtatcaaaagatggcttactcctggctctccgtcgtcccttgcgcgtcatgcacgatgcactaactacatgcacctcatcaccagtcctattgattatacgagactgatgattttggatggatcaattaattcggatgcgggcagtaggactaacaagtatcttatcgtgaacgcattacttcaaacagcgctgggctagaaaataaaaagaaaataaaaagggagcaaaggcaagacaacagttgccatgcacttttatgcattcaccgttagtaccagtcgagtttgtgttcaaggggagggattgatcgtagataactctttcaatataggaaccacaaatataagttgtaattatcattagtatatcacctctaaccttaaagtctcgttttatcatcgcatcatgggtacttgtatgagcagacctgtcattgaagacgtaaatatcgaatcagatgcgggagaccaatacacattgaatacggtaattatacaccgcagtccatcacaacccattgaggttcccagtgccaagattcaaccaacgaaaattaatcgtttaccatttccagataccgttaaattagctatgtccgttaaagattctagcttggcagatttgagttattcgcctaatttacaggctgaacagataaacaatgaaaacgatatgcctcaggaaaccacgagtcttgcaagaaaactgaaagaattgacactaagaaataaggcaaaaagaaaagtaaggaactctgatctttttgggcttaaggttattcccaatcttaatacaacagtaacgactcagccacttcaagagctgtcgaacagttatggtaatgaaagtccaagtagaggtacaaggagaaattcaatcgaagagcacgtaattccttcaaaggaaacaacagtacatattccagaaagactcacggataccgtaagagagtccaatcaggggacaaaacttcccatacttcaacctcagaatagtctaaccagtttatttcatcctagagaggaactagaaagacccggcattaaagtttacaacaggtcagtagagtcattctgcgactacccgaaacttacagacaaaagaaatatgtcccacctaaaaagatgcaagaccgaaggaagtctagcaacatcgaacagtattcctctggtaatttctaaaatagtttcaattggttctcaattattctatgatagaggatcttctaaaaaagacgatttatctgaaacaacaatctctgaatgttcgcccagtccaattggtgacacccaattgaaagacgaagtgcctaggattgccccaattagtccctatgatgaattcttgaataaccctactgaatttacatgtcgtgattgtaattcatcagtttaacggtcaaacagtccgtcatcttcactgaactcatcttcgtattcttcttcctcctcgtcgtccatagcttcatcgccatcatcatcactgtacaggtcagagtaaccgctctctgagagagcttcctcgtgaatcaatccatccaaactcaaactcatcagattctctcccttggcttgcaaacctttaggagcaacaaatccaccctctatgttacaatttgtcaatctagctttcgtattgactgtggcacctagtcccacaatgcagttttctaatgtaacatcatctgcaatggtgacgttatctaaaatgatacatcccgtgagtctacaacgcattccgaccttgcagttatttccgaccacggaacgcttcacgttagtcctttcaccgatctcagtgttgttgccgactgaagcatcggcgccaattacagcagcacctttctctttggaaacttgagcaccttggttgttctttgcttgtaatttcataaaccaacggttagcctcggtatatacaggtatgttattacatcttgcaaacgtagcttccctgggcatgatgaacatcccaactgtttcccttgtttgtctgtgtctccatgatcttcttgcaaagtctctcataattttggttgatgattttgaggcagaaataccaccctctgagatttgcataattttatgagagcaaaagtagatgaaggattccaggagcttactagatacaattgctcgggggtaacgccatgccatatgtgtgcgtatttccaacgccttattcagttccactgaggtcttggagtgcaggtccaacagggaaaaatgaccgtcttcttcttccgaatatatggtatagttagttttcaaaaatgtcttttcaacattctcaaaagggttgtggtggtagaatgccatagcaatgtccgaatctgccctgtttctataagcttcgatgagcacctgaggcggcaaatctgtaatgaaatcgcaaggtaaaaggacgaagtcactggtcagtctatctctcaacagatgaataacctcacctgtagtttccgcgtccatgcttaaacattcaactgatgtaaatggtacaatatccttatttctgttcttggcatagttcttcaccacttggtttacttggttaaaagatgacgagtccgtaactacgataacttccttaaatggggccttgtcacaccattcaagagcatattcaatcataggcttttgggcgactggtagaagcggcttgggaacaccagtgggctttattgcggagattggtgaaagtctggcccctttcccgcagcatattatagcttgaaattccattctgcccttcttgcactatctcaggttctccaaaattatccagctcactaggagaaaaaaatgagagcccagaaacgattatgggtggtacacattaaagcgcgatcacatcaatctcaaacgtcgttaggtacttgccactctgatcagacaccatccacaactccacatccaatgagtgaagaacaggaccctttgttggccgctttgaacgagaatgacgctcgtggtgatgctgaaacacaacaagctcctgtagacgaagaaagggaaagggctctgatacaattcaagaataagctccttgaacatcgtgattgggagtccaagcttagagaaatgagattgggtatacgaggactggagaaggattttcagaagacagaagatgatatcaaagctttacaaagtgtgggacaactgattggagaggttttaaagcagctgacagaagaaaaattcattgttaaaacttcagctggtcctagatacattgttggttgtagaagtacgataaacagagagagtttgaaacagggggtgcgtgttgcactggatatgactacactaaccatcatgcgtatattaccaagagaagttgatccgctggtgtataacatgaccacgtttgaacctggggaaatctcttttggaggtgttggtggattatctgagcaaattagagaattgcgtgaggttatagagttacctttgaaaaacccagagttattccttagagtgggtatcaagcctccaaagggtgttttattgtatggtcctcctggtacgggtaagaccttgttggccaaggcagtagcagcgaccattggggccaatttcattttttcccctgcctctgctattgttgacaagtatattggtgagtctgccaggttaatcagggaaatgttcagttatgccaaggagcatgaaccatgtatcatcttcatggatgaagttgacgccattggtggaaggaggttctctgagggtacttctgctgatagagagattcagcgtactctgatggaattgctgaaccagatggacggtttcgattacctgggacaaaccaaagtcattatggcaacaaacagacctgatacattagatcctgctctattacgtgccggaagattggatagaaagatagaaattcctttgcccaacgaaagtggtaggttagaggttttcaagattcacacagcaaatgtcaagaaacatggagagtttgacttcgaagctgtagtcaagatgtcagatggtttcaacggtgctgatatccgtaatgtggttactgaagcaggtttttttgctatccgagaagatcgtgattacatccaacagaatgatttattgaaggccgtgagaaaagtagtagagaccaagaagctggaaggaaagcttgagtacgagaagctgtaattgaagaaaaagagatctgaacagattataagagccgtattgttcattttttacatagatggagaataaatggattcaaagattaattttcgttgactatctacaagatatacatcctaacttctcaaattttcaccgtttctttctatcaccagaaaccttcttgatgtactgccacatgtaaggatctttgatcttattcaaatgatcagcaactctcttaccgataaagtcagcaacctctgcagacatttctgtaatttgtttgctccttatttcagctcgttcacggaagaatgctttcttggtatcggagtaaggcatagctggagattgaagaagtttgagatccttcttggttaggagttgttgctttctctcgaatcgtgatttacgtttagccagggggtctctaaggttcaaatcactggggatgtcagattcgaaaatggaaacgggctcatatgttctctctaatgcgacagcctcctctgtgcaaaacttgtcgtcttctggtttatctggtctaggccatggtataatatattcttctttattcttaatgcatctatatggcatcatcttcttgtagtcttcatcccagtactttcctctgaaaactacgtcattggcggcaatttgtctgctttcgccagaagtctcatccttaattgttcccactagcttgaaatactctgaagtgaccactttaggatattcgacgacatgtgaagactcactttgaagccagtagttgggagggatgacaacttctttagtgggcccatcttctaacataaaaccattagtttccttttgggtccttataattgaagttactgttcccttaagggcgcctttgacaatcatcaccttgtctccaacggtgtatttccaatcctccaatgatttgaattgtttctcttctcgaacagcaggaagatcatttctgaccgcagggatctgaccttttctgtttatgttgtcaaaatgggccttgacaagaggatgcaacctcttcatgttggcaccataccgtttactttccttcaaaagtctggacatggctatttagagatcgtagactttttcagttggaactgctaggacgagcgaagtgaagcacccacgaaaaattttggatgagtgattgagtggattattgcctaattcggatatagttatacattattaattctctgtgcagatatttatgaactcctcttcattgactaaatgtgttaatacgttattgctatcaagggatcagttggttgttgaagatacttactttctccatcttcgtccaaatcaaattcgtcaatcatggctcgtagttcctcatctgtcaggttttcccctaactccttggcaactcttcgtagattcttcaagctagaagttgttagtatcctgagatttggtattcaagggcagaagaaaattgtagagttgacgatattgtctggagagtttcatatcttccatttgcgtgtgcttctgctcaactactaccattagattcgaattgaacttggatactcaccttatttttcctgtcccatcatcgtcgaataatctgaaagcacgacggatttcatccagtggatctctcttagatatcttgtccccaacaacaccaaaaaaatcgtcataactgatcagtttcttgttatccgtgtcatacgtgtgaataatctccagcacttctcgttttggaagatcaaatcctaatgccttcaatgctaccttcaattcgtggtagtctagatatccatcgttattcatatcaaataaactgaactgagggaccctggtgttagtggcaagattttaaaacgtgaatcaactgattcgagagaaaatacgtacagcctctctaatctcctgcttttgctcattgaggagttcaaatttcatgggacgattccctctctgtgtgttcattgtaggatctccagtgatttgttagaaagcttcttcgataccagacgcgttctgatagattaatgttcgcgctagatctactaaggtaattaatcgcgagttctgtatccctctaatctggtctacccgctcctgttaaagatgaaagtgggagagagaattcaggtgaagggggtcgatggggttgtaaggttcaaaggccagacccaatttgctgatggtgagtgggttggggtggaactggatcagccaactggcaaaaacaatggatcagttcagggagtccaatatttcactataggtaaaccagatgccaacgataccaccaatctctacggcatatttgtaagaagcaccatcttggaagccccagataatagcaggctgaagcaaattgtgtccaaacttcaagagaaacttcaaagatataaggccactcaattggatcatttgaaagaaataaatgatctgaaagagaggaacaaagaattgcagagtgaattggaagaagtacaaattcaactagagatggattttgtggacaaggaactgctggaggaaaagaatcgtgatttgactattcgattggaggagataacagaccaatttactgaccttcaaaaggataacaatctactccaagaagagttacaattgaacaatgacctagaaagtgagcaatcaggactggatgaggaaactaaccatgatgctttgttgaaaaaggtcaagaaatttgaacttgcactgctgcaacttaagaaagtctcttctgctaatgagtcgcagtacataaaaagaattgcccaattagaggagaaactgtctacactatcatcaattgaaatcaaatatgaagatgctttggctgctcttagtgaatcgcaggaaaaagtaaatgatctcaagaataacttggaaagttttgacaattcagaagaagtcatcgagagacttattcaacaaaatgtggatttacaagagaaagtcacaaccctacaagaatctatttctgaactggagcagttggagaagttagacaaggatttggaggaaaactaccttcaaatggagaatgacttaacgacggagatctataatttgaagacagaaaaagagacacttgctgcaaagctttctctattagagaaggagaacaaagcgctcaccgaggtgattgaaacaaaaagcactaccaaaagtaggatcaacgccaatagtagtgaggtttttggaaacagggaaaaggactcccttttgcacactataagtgatttgaaagctaagctctacaagttaaatgacgaatgtgtagggcataaactgagtagcatttttcaagatttaaccagacaggaatttgaatcgatgaatcgagtgatgaaactgtttctacctgctgatgaagatttctctctgaatactttgaaattggtatcgacgttaatgaagtatgccaggcttttcagtatcctcactgaggaggagctatctccagttattttgaatcatgatattgtatttagcagactcactgttgagaacttttcgttgattaaggagctggagattatgttcaggatcgattgtatatactacagtgtcaacagctctttcttaccagacatttcagcgaagcagatctcagactccctttcacaactacttgagttgctgaagaactccgatatcaaagagttacaagcagtattattgcaaacaaaaaaattgtgggaaccattttccgttataaagaaggataacgaagagcaaaatatactgatcactcatcttcaaacaactcatcgactctcgcaagtgtatttaaggaatgttcaaaaagctagaaatatgatagcccaaatcaagtcggtgagctccaattcacaactatccaaaatcgcccagttccatcttcacacatctttgcagatccttgattccgtagaggatcgtatcctcagtgtctataatgaatttcttcctaaccattttccttcccagataaaaactataaatgaagagattgccacggacaaaagtaccactcaagctttgcaaggtttggttgataaagtaaccattctagatttgaaggggagcgacaatttagatgaaatggtgaattcattccttgaatcgttgaacctagataatctgcggacacttgagaaatttgtccaggaatggaaaccagttgatctaggggtagagttagaggccacttggttgaaccaagcaaagctagttcgtgaatcgtggagtcagttatctgggatctcagaattgaaggaatcgttatcccagctaacatcagagatgaataataaagagcaaacaattgaataccttgagctgaaagtggccctatcagaacagaaatttaaacttctcgttaaacagcacgaagaagagatggaagatatcaaatcaagccatgaattagagctgcaatccgagaagctgaacagaaattctaactatcttgattcggtaccagaaacttttggtgggaaagagtatcttgaacagacagctcaattcaaacaaactcttgacaatctgacagacttatattgttcggatgaagtcctggtgtgtccagatattaagattcccaattacaagattccaacaaaatatatggaagagatcaagcacattgggtcgcttcgtgacgaactcatggcaaataagtttggagttttgagaattgcagataataaagactcgtttggttacaaagttcgacttttgaaggagacttatggagagattttagagagatatgcccaatattagactgtagatagatatcaataagatttcaaggccaaaaaaatgaagcccaacgcggggattgaacccgcaaccttgtgattaagagtcacacgctctaccgattgagctagccaggcagtttacatgaaattgtgtgattttagctacataaagttataaatggtattaggatcagactacagatcactggtagtctacgtttttgactgcaaatgttgtaccaatttttgaacattcatgagaaactgaagatttaagattaaagtcttagaattccaatggctttagcgtattattatgaagactttcatctttactttgctatcaaaagcacagaatccgtcctgacggttagttgaatgcttagtaggtgaaatggtacagatgtatctagtcagccagaagctacaaataatagtcctaggcatattcaatcaagccctgaggttcacacttatttttcacgttgcaaggtctgaaagaaagtcatctgaaatttgagatttctaccagatagccaggtaaatgaacatccatgaaaccctcatactgggctacattacgaagaggaatttgctgattaacgcagccctatagttagttgactgtggtagaataatcgtttccccaaacaggctttaatttcccttttagtaatatacgcgactatatttctattgttgtattgacgtctactagcaataacaaactatcgttgtcaacaacacgcacccaacaacgctgcaaatcctaagcgataagctgttcagtttgaaaggactgcaaatacacaataaaaaggcttagggaactcttggaagcccagaaaacttcagttccacgcatttccaccaactattggagaccattttctccagtctgtcataggaacgggtatagatttaacggttagatcgtcccacgaaggttatcttcctccgcttaattttgctttattcaacaattattgtaaccgctttaggaaactgctaaacattcaaaagaaatttcaccagtcgaaggtataatatagcactcatgtctgtcaacttggaagaagctcgttcctccttaaaacccccaagaagtaaggacagcaaggctgaaagcattcaggcgagaacaaaaaccggtactctaatacaacattttaactcggtggacccaacagaattggagagccatctaccaagccaaagtatgtcctcccccatagtcaatgaatctcctaggaagaagacccttactaggaattcagcgtctgccaaaaaaacagataaaaaagaaaagagtttgttctccagaattaaagaagtgactaggagcaacagcaagacaaacctcaaaagagaagcgtccaagtccaacattttttcactaggcaaaaacaaaaacaataatgaggcaccctccaaagtggtgacaccagagcaaaagaaagtgtctagtgcagaggaagacgaaaactccaatgccaacaaagaactgctgtttgagcatccaaaatgtcaaatgttgctatatgaaggaaatattgaccgaaggacacctggtaacgcatctgcccgaaaaggaaaaacagttggtcaaggaaaattcaaaatttacaaaatgcttaaggatgcaccatacatgaagtgtggtcatgttgtctatcctttactgcctaaactaaggatcattagaattgccatgaatcagtttatcttccccattcacaatcccgaaagatatagacaattggtcatcaacagtgatgacggagaagtgctggacaagttggaactgactttttctcaactttgccaatactctactctttttttccctgttcctgcctatagcgagaaatctgatgatgataatgacgcaacagagataatatacgataatgaagaggatgtgaacctgaatgtatctggcgatatcaaagattttaacattatcaagatcagctcatcgacgcctaaaaagctggagcgagatctctcaatcagtagtgatatggcgtgtttaagtgaacaaaaagatcaaatagaaaagagtcaaatgaaaagggtacaagagtccaaagtaaccaaactgaatcaagaatattcaaattctactctttcatcactggaagaagaattgaacatgtttgaaggacagcaggctccaactctgacaaccattggtgtttctcaacagacagcagaaactgcaacctacgtttctgcagcttcgacactgaaaaaggactcatctttggaaaatagctttactgacactgctcagcaaactgatcaacttgacgagtcttcaagaatccaagagcaagactccaccacaatggacgaatccgttgatacaacaactggttttgaatctacagttctctcattcgactccttaaatggagaaaaattctcatccactctcagagattatttgagctctcaaagaagtgctagcactatcgtttctgctggtgattcttccgacggacgcacactcagacagtacgggtcaacgctctcactggataagacctacgtttacgacttactaaggggcaaccgtaccaaagaaatactggatcttcaattcagcagccatccttccatcattggtaagatctggcattaaaaagacaataaataggaccccttgccctttctttcttaattgactgtaatactactgatttctaatttcattacataatcacaagattctgccgcccaatatccaacgattgaatatgtgtaccaaccaataaaatcgaaggctcccttggttccttcatccatcaacaatttttcatagtaattccaaggttctaccacgttcaatcgattccaaacactgcaagatcatgtcaactcccaatcctagtcctcttggaaccgatatatccaaactggccattcccacattgccaggaaactttcctccagagacacagaagtctggattttggtcatccaaccccattttctactacctgaacaacgtttactcttcagtgtcagagcaccgtcagtctttgaacttggtcaacccaggggtctttgagaacctcacaaaggaagtcagccgtgatgttttcctcaaccaatacttttttacaggactgagagcagacctcaacaaggccttcattatgaacccagtgttccagatttctcatgctttgtctattggatccgaacaaatcccaccatatgcatttagtgccttatacgccaacgacaacctgttcttgcaaggtaacttggacaacaacttttcattgtctggtagattacactacggatgggataagcacaacatcactaaagcaactttgcaaattgttaaggaccaaccaaccatggctcaactggagcaagactaccagggtaatgacttttccttcaacttcaaggctttgaacccttctattctagacggccgttttaccggtgttgccgttggatctctcctacaagctttaaccccaaagttggccgttggtctggaatctgtatactctgtccaacatccttcttacccagctgaagctgctgtttcttatgttgcccgttataacaatactaactggattgctaccgctcagttgcaagctcaaggttctttgagcacctctttctggagaaaggttaccgaaaacgtggaagctggtattgagaccaacttacaagccactatgaagcctttgacggacccaatcatgggtgccccagttggctttcagccagttatcgagggaaccaccactcttggtgccaaatacgaattcagacaatctgtatttagaggccagatcgactctcaaggtaaagtcgcttgcttcttggagaagagaatcctccctactgtttccattttattcagtggtgagttgaaccactttgacaacacttccaaattgggtcttggtttgcaattggagagcgctggctccgaagaactgatgaagatgcaacaaggtttgattgatcagaacggaaaccctattcctggagctcctcagactttataaatgtatatatttaatgccgccttttctacttaactgtgtgatcacgcttcatcaccatctccctgaaatctagtaactcctgtcttttcctagttatcttctcgtccagctctctcagcttattgattctgctttcactgctctctgaaagcccctcaacgttatccagtagacctcttattttggaaatttgagctcttatccgaccagcagcattgtcaaaatccttcggttcgatttttcccaacttgagttcttctattagatctagcaaaagtggtagcagttctactttccgaatttctgttaaagcgatgtgctctttctccaattgatctactcgcaatctggtttcttcgtcaatgtcgacagtggcaggctcactttcagtgctcctgatgcttccctccaccgaggtaaaatccttttctatttcgtatggagtgcccaacttactgggtattttcacctgggacgtgaacatctgaaatgaccccgataacgtagatttcttattccagttcactgccctatcttgtatcaaacatccagagtagcacaattcgagcacatctgctagacggaaacacgctagaacttctttatccgaagtgtcttctttattcaccagcgtcaatctgtccattcaaaataggtggccatgtctttggagaaccccaaccttctaccttacttcaatccgaaaaaggagaggcgagtggcttttataacaggcgccaacagtggcattggtcaaatgaccacgttgcatctctacatgcatggttacattgtctatatggcaggacgaagcaaagctagggttgatcaagcaataaagtttgttcaaaaggaagcacgacatagaaggtggcttcctgaccaaacgtttggggaactgaagtatattcacctcgatctgatgaatttgaaaagtgtcgaacgtgcagtcgtggagttcaagacacaagaaaaagtgttgcatcttctgatcaataacgcaggcgtgatggctcttcctttctatttgtctggagacaaatttgaagtgcagatgcaaacagactacgtggcaccgtttctccttactcaaaggctagtgcccttaatggaaaccgtttcagatccaaggatcatctatttatcttcaattggccacaacttttgttttcgaaggttctctccagattcacagtttgtgtactggcctaatataatattcacatggtttcgatatggcttggccaaaactgccggtattctctacatgaagacgttagccattcaacatccaaatattctttgtctttctgtccatcctggatttgttatgaacactaacctgttcagccatttcacaaggctgcctttaattggcacatttttctggttagcttttcaggtgtttggttggatttttggtgtctccaatgaagatggcagctattcaactgttaattgtgcattatcacctaaactatctgcatcctcagataacggtaaatactttactacttatggcatagaaacaacacccaacagggtcgcacgagacttacaatacggcaaaatactatgggactggactcaacaagaattgctcaagaggggctataatacttagctctcgctttataatagctatttgtctaactacaagtttttaatactaataccaggttctcctggaacagcactgtcaacaacctttcctgtggcagtaatctctatatctcctccggtctcaatatccttaccaatcttagatcctggtttgaatgatataacttgaaattgctctaccttgaggatagctggactgcgcttcaagttatgcagaacactcttaatagtttcttcttcgttgaaggatgcttctctattgaacacaacttctggtgattcttgttgcagacgttgcttcaaaatagagataaatggcatagcacgttttatctcctttggctctatcttctctctcaaactcttggtatcatctaacgtttgttgctcaaaggcctcacgtactagctcaataaattgagtttgccattcagggaaggtagaagcaacatacaaggtaaccttgacaggtttagatgggtctaattcttgttttcccttcttcttctttagtccagcaccttcaacctctctgatggaccgttgcaggtccttaacatattctagcgcactcgttacagaaacggcgacaggctttgaagctcttgggaaagcagcaaattggacagagcctttgttctgcaaaacttcacggtaaatgtactcagcaaagtgaggagcaactggagcaagcatcaatacctgggtctcaatgtatcgaagaactaagtccctgtgcatgtttccagcaccgacagactctctataataatcacgagccgtctgataatcgaacaggccgtattttaaggcagatttgaagttggtcagggagtattgttcgtacgtctcctcgatcagtctgttcatctcattctcaaaggcaacatcaaagaacttttcaattggaccggatctgagagagtcagcattcttgacaatttcctctgcccattctttgaaggtaaagagacgaagaatggcggcgttggcattgctttcatcaagattggcatcttccgttgtatcaccagcatcagctaaagcaatacgagcagcatcggcaccaaacttttcaactatttggtgcaatgtcatgaagtttccagtggattttgacatcttggcattgtttagcattaaatgaccattagcacggatccctttgggccagaatctcttggggaacaaagctgtgtgaacatagatacagaaggtcagatggttaggaatcaaatctttaccagaaatggagatgtctagggggtagaagtactcaaactctcttctcaattttttcaggttctccgctggaatgtcggacttgatttcttcagtgcggcagaaaatgtaatcaaatacatcgtcggtcatttgatcagcagtaattcctaatggaccgacctccttaccatagtaatcagagtggagcaggtggcagaatgtgtagaaagaatggtaaaccgtagagtcagacaatgactcgacaaggtacttcttgtcccatgggatacgagtacctaaaccgtacgttcttgacacagcccagttcttcagccagtttaagacaccttcaaaggcatgctcagtttcaggactgaacaggttcatattgtcaagacattcaagtgccagcgccttccaactttcttcaccatagtccagataccattggtcttctaaggaaacaacacattcatctccagaacgagacatgacaactccctcgggctcattgtagacgaaagcagtgttctcctcaagcatttggtctctgactaagcgcttggcattctcaaccttttcaccagtgaatttaccataaatcataataccgttgtagaaaccttccttgtaagccaattccttggcctttgccaactgaacagcgtcttttggcgacttgattttgagttcgtttacgagatattcagcacatttgtcaccgtacttctcagttctaatcaaagcgacaaagtcttcaataacccattccttcttgataccatagtactctgatttgtgggctaagtccctggtgttgatgtagtcatcgggagaatcagacggaacacaagtgacgacaccagttcctttgtttggcaagatggtatccataggcaaaattctgagttctttctcagcagccaaaggagcagtgattttagaaccgatcaaaacggaaccattaatttgaaccacgggcttgtagtaaccacgttgaggtgtgagaccttggaaggacatattcttgaacgcacgttcagtacaaatgtaaaattgcccttgagcagcttcaaaaataccgtaatcaatcttttttgagacaaaacaacatgtttgaccgtacatagtctctggtctcagtgtagcagctaccaaaaatatctcgttagaagcgaagtcaaaattcttttgtttcaggtatccctgagcttcgggagcaaattcagtaatcttgatttttatacaggtgtattcttgaggagtgacaccttcaccagactgtctgtcgtgatccatacaaggttgaccgtctttttctgagtaaatagtgtatctcttaccaaatttgatctttccatcttcctttagtttgttcatttgccacctgacaaaagcatcataatagggattaaggtcagtggtgatcatggaacgacgccagtcaacacgggcaccaaacgaagtaacatcattctgacacaagggaggaaaataagttaaccaatagtatgggtccgcaaactttggaatttcttcatctggaatacccagctgctgtaagatttcaaattgaaacttacttctgccctgtttggctacaaccttggattttttagcactgaacttcgacaggtcatctctctgcttaacctctttgggggcaggttcttcctcctcctcagcatcagctgggaatctggaaaagtcctcaccaaactgctcaatttctctggccaacttgtcagcagcggcactgattggcataccagtacagtggaaaccaagtgggaaaagagacttcttaccagtcattctttcaaaaccgttagcaaactcaactttagataaagtgaacccatgaccagcgtgtaggacaccgttcatgtaaggataagccattgaagaaaaatgttttggtcttcttctgtgtagttcgtcactatcaataccgtaaggttcttcttcaaaagtaggtgcatctacctcaaacaccttttcatcttgccatattttctgatacttcttttcgatttcaatcaaggcatccctacgagaggtctgttgataatgttagtgatctagagtggtaaaaaaaattttcaggtcgtgaattcgaaaattgcaagccatgaaaactgttcactgtttggtaccaacttacattctcgaggacgatggtcttggactctggagcactcatactctatgaattaggaataaacaaatacagtcaattgtaggtcccccagtgatattagtctagtcttagaaagaagatcggttcgctagacggatattagagatgcgagggtgaagctcgaggaaagccagtttattactcgaaacagatatacgttggatttgatatatatggtatacttatttacagattactctttaggtaaatgcatgcggaggaatctgtccctgttgatgagagctcctgaaggcttgaatagcagcttcatagttccaatggctttgctcgcaaagcatcaacgtaaactcgggattgagtttggtctccattaaaactttgtgggccagttcttgctgctgaggtgtaagattagtattaagcagctgggaggtgggttgtggctgtgtattcggtacttcagggtgaactgctggatgtgtaagtggtgtggacgttctggatatttctgtggaaccagcggctgaaggagtagttcctacagctgcttcttgattcctttttgtaactacccaggcgttcgtaggaatgtgtggccttatcaacagaagatcagatgccactatcattgctccattaggaccaaagacaatcacaaaagtacggtcaaatgaacgcttggacagagaagatctttggcctttataatgagatcttacaccagattgaactggttgaacaggtgcagccgtttcctcaaattccccgtgtagtgatacaatgataccgtttagttgtggaaaagaccaagattctatagcaaactgatctattttttctaaaagcttgtgtgatgtcattggaagacagttgaacagtcgcaaaatttgttcttgaccaactgctaatcgtgacattctagatttttcatttgaaattcttgtcaaattacgagaatttgaaagataatatgaccatgagttgccactaggaacagttgaattgcctgtaggatccggagaaggatgtgcagtgtcgatttggaaggagaattgagactccggtgcgtataattgaagtagttggtctcttgcagaatcccataactttaagtaattagttaaaaagtttgttgctacgccttgtgtggtctcattctcaaaaaacatggatacggtaggagctggaaatttgaaaattgtggacactttattttcatctctaacatattcaccatccaacatgattaaacgcggaaaatgtctgattacctccgatctgtagttacggtccatcgattgagttgtgagagggttattcattatcaccagttctcttaaacgagtgaatttgtgtctgcaattttcaaagaaacgaaccttctgaatgttattatcctgcagggacaaattcttcacacgtggaaaagtactgcctaatatggatagataagtatttgaatcgttgatgttgttattggccatgctaatagtatcaacttgcaagttttcttgcgatgctaatttcattaaggcagggaacatcttggaagaagtagaagctgatgagaataaaccctgggagactaaagttgggtcgttgaccatattcgtcaggtccaaaaagcgaatttcggcattataacgactcaacagaaactgtttcaacaattggatagtacgggcagtatctggtgaaccagcgttaccatttccgttagtgctagtgttagctgtgatttttagactctggccggcaaatttgacaccgttccaattaaccaaatcagtggcgtccttctgggtatttaccgtagcctgtatcgttccagtgtgatccacaatgacattttgcaactttatcctggttttccttgcgatgaaagaaacaaggtcatctttggacgcgttgttccagtttcttatttcgacagtaaaagagggttgtgctgcaaaggattggtggctcgagtagttattacctccgttgaactgatttcgtccataacctcctcttcctctgcctctgtaactcattggttaagtggagaaaaagactagtgggttggttttttacttgggccaaatgctacaacgatactctccaaattttcgctaaagggagtctcttccgcctagaaactattatcccagccacgacctttttcaaaaggcgagaaaaatcgctgagatccctactttgaaaaatgagactaggaaaactagtagacgtgttagtatcagaaacgtaacgaaacgggcccattgaagatggcacgagtcgagtatgattatgatgaatccgctgagacgtggccatattttgtcatcacattactggctgtggttttggtcccaactaccatatcgtatgtgagcaagatttggtctagaagttcctctggtcggaaggcacaagtcaaaaaatatgcaacttcttttaaagcctccaatcacgaccaggtttcgcaattgacggggtcaaagggctctgggaactatttcttgtttagtgacaagacgctggtgtttctgatcgttggatggtctctgttcctgtatgttggatatgtaattcataccactgaattagtggctgacgctaacgtttttgacccttgggaaatccttaatattgactcaagcgctaccgaaaaacagatcaaatccgtttacagaaagttgtcgttaaagttccatcctgataagttgggatccttgagtgacgaggagaaagaagacgtagaaaccaagtttgtgttgatcaataaggcttacaaagcccttacagatgaaatcaccaaggagaactttctcaagtacggtcatcccgatggtccacagagtgtgacccatggaattgctttaccaaagtttttggtcgatggtaaacttgcttctccagtgttggttgtcatttacatttccatgatcgctattgccttaccgttcgtagttgccaagtggtgggataatgttagatcgcatactaggcatggtctgcacatcaagactgctgctgctttttcatcctatattatcaacaacaaccctgctaagttgatcaacaccgaaacgatcatcgaactcataagtaaagccgaggagcttaagtctgctacgaacctttcatccgaagaaatagaagaactgctgttggcacagttgaacagggtattttttgactccaagaaggaactccagaagctgaaagttgtttctttagttccgaagctaataaatgggctggtcgatattgctgccactttcaggaacagtgaattgtgtgtcaaagctattgaggcccaaagatatttgattcaggctgtcaatcctactggctgctcagatattgaacaactgttgcagcttccgtttgtagagaagaaagaacaagttagtaagaagatacctgtacacacattagggaagctcaccacgatttctgatggtgaaattgctgacttggtaggcattgacaagaagaatgcagcagaagtaagatctgttgcttcatccatcccagtgatcaaagtattgaaagctgaattcaaaattcccggtgagtctgttgtgaccccacaatcgaatgcccatattgttgtcaagcttctgatcaagtctccagctcaaaagggacaagctaaagtagatgatgaaaaactggaagagaaagaaacattcgaatctcttagagatccttttagcatcgttcaggatcaaccagtacttgcatgtttaccagaatccccttacttcccagtgactgttgagaattctgaatatgtcaatggatgggcggtcttactgacggttcaaagagatggtaaattggctgattctgtagacttgcttacaagaggcagcctttctaatttagaactttcccagaaagcctactctgatggtgaagaagtacaagttactacttacaaattgaaactcaattcacctacacctcctacgccaggtgactaccacttcaaactgtcattcaaatctcttagttacttgggttctgatctggatattccccttgtaatgaaggttcaagagccaccaaaggtggaagatgctggtgtctacgacattgaagacccagaggaagattctattgctggagctatggccaccttaagaggagaaaaggtcaagacagctgatgatgacgatgatgacagtgccagtgacgaggaagatctggaaatagagagtgatttcacagatataaatactgatacggaagatgagggtgaagataaatagtgatagtgacagatcaaatattgaaaaatcccaattagatatctatagttaaaactgtttctgctggacgagcttccaaattttccacagagtctggggatgcttttataaatcctttttcgatgagtctggactcgaactgcggattgttggtttgaacagaaactttctgaaagttattcgacttagcatgcgtaattgcaaagtcgacgagtttttcaaacactccgtgctctaagtactctggcaatacgcttagtgcttcaatatagacagttgtatcattaatgaatgctgttttgatcaaccccacggcaatctcgtcgtagtaacctaatttacagttgtccttcacctcaagacagttttcaacccatgactctgtgaactcaaaagttgtgttcgaactgttttttgatcttgaaaagtctaatattttggcaaacgttccaatattattgaccgtcaggtcatcgacagccaagattgatctgcccatgtcgactttacttcgtgaagagtaaaacagaagaatcacctcgtatagcgaattcccccattccaagaccagtgccatgacaagatgaatagatgaagttgtgatcttcaaataccgctatgtgatagaaaaccacaatgctatactattttcaacctacttagcttatataccttaaacctcttacctgggtcccatgcctactttcaattcttcactcatctaccagaaccccgactactggatacttgctcttgaaagtagattcccagccattcaacgattccaactcctcaggagtcaaatcagccaggtcatcaattggttccccatatgatcgaatgacgtccatctcaaatgaatttttcgccaaacctctggaggcatcatggccagcaaaattggagtaaggtccgctgggtccataaaactgtctggctttggaaacatcgtagacatttcgcttcacggcaatataaatattttcagtatcaaacccgttgaacttgtacaaagattttggagtgaatcttccctccacgatgggctcatcttctttcgcagcattggctgtctgttgaacgttgctcaaaggatcatgggtgctcaatggggcaaacaagatgtttttaataaataatccaactaaaacaatgaccaatatggcaattatatagttttccatggccagcttaggttaagtgagtgtaaagaactctgcctctctgtctctgagttaggggtgtagtactccatctgactttcatttttcagtcgcggtacgaatgcaaatataatttcgggagacagatcgggtaaacgttccaaccttattccaatcgaaatatactcttatcgaaatggctttcatcagcgctgcaaattttacatatattcgactcggatacctgctcacgttgtccttcctcctattgaaggatcctgtgtatttggttcactacccaatgattatcctgttgactagagcgatgaatcttccagagctggaaatggatgagttgaaccccatttttggtctaatttctgtcctgattcttctttatgctgttcatgatttgatacctctattagaaggaaatgtcgtctacttcagatcaattgtcccagttcgggtttcactgtttctgatcctgatattctactgctatgtgggttcatcgtactatctttgcaatgggttgatctttagtttcttattcatggagatttggttcaactttttcctgtattctcttttgaatgaggaaaaagagaaagaatcacagcaagaatcaatcagtgccaaagtgattcaagaccagattttacgaggagatcgggacgacgtggaagaaatcatcaatgagttaggagagcaagaatttgagaatatcatgtctgatttgaaagaaagaggcagtcagtgaatttaccctatttctttcctaagctagtggcaatgttggcagcttcttccacacctcgagcgataccacttctgactcctcggtcttccatggccataagaccaccaatagtggtacctcctggggtgcacacagcactttttagtgcggcaggatgttctccagtctcgagaaccatccttgctgtgccttccataactttagcagctgcatctttagcaatagcaaatggtaaacccttttggacggctccgtcgatgagagattccatcatcaacaagcagaatgcaggacctgaacctacaagagctgtagcggcatccatattcttttcgggcaatctaatagccttgcccactgggccaaccagcttgagtactagatcttcgtattgctcggcgtgcgaagatagagatacacaagccattccacatccaaatttggccggggtattggtcattacccttgctacatatttagagtacctttctagttgggttaacgtccagccagccaaaagtgaaattagcaattgatcgtgtaagccctctttgacctgttccatgatttgttcacaatagaacggcttgcaccctagaattatgatatctgactctttgacggctctgatgttttgctcagatccgtagctagtttcaatcttggaataagtgctggccaatttttcagcggacttctgggagcctgtgcagcagataattcttgagggataaggggagaactctgagttcaaaatagcagataaaactgcggttcccatcactccgcaccctaggatagtgattgtatattcgttaccaattgaagacatctttattagtgattaagcaaactaaagtgggagataagacagaagttagtgaaatattgcaaattcaaatgccgatctggtagatacatgggaggcgcgaaacacatatatagatcttaatgataatgatagtattatataaggcaatgggatgggcaagtcagattaccacacttgcactgattcgtagtaatctactctcttcttatagtttggggtgttacgagctatggcatctctgacgtgatcacacatatgtggatggccacaagttaatacagagacggttccattggactcgctgatatctctattgagaacttcctcaaggttaggtcttcccgttctgaattcgacaaaggacaagcggtccaattgtggagtggtctctttggattctgcgatttgtttgttttcatccaatgaagcttccgaggaagaagaggatgaataaaagttcactttgtctactgatgatgttgtgttcgtcacatatatgacaacttcaacgtttgacttttctaaagacttgatctgtggataaaaccagttcagtgagtgccaatctctgatgatccaatacagtttagtgtggactttcaggtttcgttcagcaacttctttggcctccgcaaacggacctggaacaccgtttccagatgcaattagcagagaagtgtcatatttgtggacgggaacgctcaaaccgtaaggtccttccacgcaaattctgaagttgcatgtaagatcatcattttggaggattctcttcgaaatataggaagtcaggcctcctttcaccttgacaaagaaatgtatgtgctttccgtcttcggaggggacgaccgtgaacggatgtgaccgataaaaggttaaaggagtcataaagtagacgtacccataggcattgggaaatgatcggaaagatgcatttcttggaatggttaatttgattgtttcgttagaaatcaactcagctttggaggttctcatgccgaagctgaacattctgacaagcctaatgaaacgatcaaaacaccatatagctgcacatgcaatataaaattgctcgtacacttgacttgcagcatgaatccatgcggcagcaaggaatacggccaccagaatgatatgtaccaatacaaaaaggtcatagttcgcttgtcttatcctgtggacggcaccgataagaacacatgctgcagcaactgccccaacgattccccatcgatagtaattggctgctaatctttttgtgacctgttgggggcctagagagaatgtttgtaccgtgaaggaaatggcgtgcaccaaaatctcgcagaatatgatcctagcaagcgacttgtggaatgtaaggaatcttgattgaggccacttggttacatattggaacaagttgtttcttcctgcaaaaataaataacaacggtagatggtaagaaagtaatataccacttctatcaccatgatatcgaccgtagcctgtaccctgattggcaaacactggatcatttttttggtatgaaaatcctagtattccattggctaagacacagtagacaaagaagatagacaatattgtggtctccaaagttgtaggcgccattcctgaaaaaattttgaatttggtaactggctttgcatgatatccaaaaagtgtgggcaaagatatatactttctgtactgcctgacaagcttattgttcagggctggtgattgagccaacttaggggctatgactcttgtccaattgcaaacaccagctaaaagcagaatcaggagccaataagacaccgaggcagcagcaaggtaatgtgaggtcttatagttatcgtatctgtgactgctgccaatgtaatacattttttgccatttggcgtatttttgtcccttaataggcgatgtaacgagctttttcttgctaaaggatgtatctgagtcgatgtcaataaacgttacagaggagagggattccagggtcttttgtatgctcgtagaatttagtttcggacaacgatccagggcctctttttcaatagcgctatgggataacgaagcatagttctctgcacagtaaagaactgtttgcaaatatggttttgtctggcacatgcaaacgaatttcgaatccaacgtcgagttactacaaaacgttgcgacttcctcaacactcttcttacatgaatcgaatttcagctcttcagtcgagtggaacgtgactaagtgggcctgagctgctactgtgagaagcaaaaacaataccactagatcatttaggtggtttctcattgttttacctttttgcgctatcatcggctgtcccaacctgtatatatatacatatattcagagcatagcatagagccccaaaatgaattctttttaagaacggacaaatcagggcacattaattgatgatttagcataaaatttccatgcacatccaaacctgtttgtacaggactacaattgatcttaagctgaccgaggcctttaaaaacactaataacgaaaactgtttaactgctgttcttcggactccaagtcaaaacttctaccatggtcagcaaaccaatatcagagctctgatgggcttttctctgacttcaagggttcaactttgtgattcagatcttcaagataagatcaactagtggaatgaaatttttggtttaccgcctcacctctcaaaaccgcatagaatcctaactctaaaaaataataggccgtaaattttggctgtactcctgaacaatacatcgtcaggacctggaatttattgacatacggctgaacagaaaccatttgaaaaattttaattttaaaaaagatactttatgtctcataagcatagtcaccactctcaagctcagaagaagcagttctagcagatagtttctacaaaatgacctacttcgttacctctgagaagggcttaacaattaagcttttttattggtcgcgactttctatgcactaattgcataatgcaacttgttgcaggttcaacgttagcacttgtcccactcatataattttagttatgaaattgttcagggctattgcgagacgccaatactttggaccagaaacatattttgcaattctatactctaaaggaaatatcttgactaacgatcagtttctgtaagatcatcttcttgccagtgatctatgtttgtctgcttttcttctagcttccttttaggttcctttggggggtaaagaaaagttatctgataaatcaacataaaagactctcaaatcaggattagatggtatcctgaaagtttaaattaggaggtggcattaatgagatacaggcgaagggggctagatctcttcatctcgtcattggttacaaggatataggctgctaagtttgtcagcaaagtgtatctcgcgtaaactgagttataatacccttcttatttaagcaaccgtacaccataagctgtttcaacgtattgttattggactgaaatctcgacgttgacctcgcaattgatccttaatattggtgaggaaaaatagtgctgtaaagataagcttgcaaggtaccctgttccaagacctagtggatggctacagtcccaagtgacaaacacctcgaaaggtagttcaaaaacctttccatcagatgctattggtaattggtaaagttgattcgttttcatcacccctctattgtctctgcgtactaataaaaaaaattcatctaaataacgtaaaaaatttaaattcccaggtatgattcacttcagatttgtttttccaacataaatgcctggctagctcaatcggtagagcgtgtgactcttaatcacaaggttgcgggttcaagccccgcgttgggcttcctttttgctatttttgttaacttcagtaactaacttagctaaaatcatagattaaactattctctagtagcttccaatctcccaaaaacctaaccaagttgaaaatggtcctctttatattttcaaccaattcttcatcctttaaatcgtctactttgtaccaagtaatggggaggtatgctttctttgagtaaacgaataccaaacattgcaaattgtccatctccccagatttcaacaaatccgacatctgccaaagaggtatcaaaccaggacaaacgagaggaattgtgtccttctcttttcctgcgccaaactcgatatggtattgatctttcaggcaggtgatttgaagttgtgcttctttatatgcctggccttcaggaccatagatatcttcagcaatgtcatgtaatggtgaaagattcttcgatgatggttttaggctgctagttattttcaactctttattggccttgccatcaacgtcagtgacgataaacttaccttgataaaaactatccattgttaacctggcaaaatcaataaattgactgttgcacagatcaagaagctgccctccaaatttgaatttatacttcatttttgggcaatcggcaatatagtagcccatatagtaaaactgcttacccagtctctcggctaacactgtttctcttaaagctgacaatgtaccaaggccaagatgagcatattctgggtcccaaataaaatacaccgatgagacacaattaggcaacaagtctaacacggctattgcggctagctttccatcaatatagtaacattcatgcactccccctaaaaactctgacccattactactgaattgggggtctttccatgagttcaatgatttccaataacccagttcatcatcttccttggaatcaacgaaaggattgtcacacagaaaccgtttgaatccttcctctgtaacatccttatcaccgtgaaccaccatttgatatttcttgaaaagtgcatactttgcctcagaaaaagcagtgctctcaaattcagtgtaaaaccttgagctatcacagcccaattcggcatccagcagtcttgattttagatcaaagggcccttctgttactatgttagcgccaatatatttggcaagcctgttaacatggtgcctatgttctttggtaggtttcaacatcgacaaagacgtcctaatagtaaaatgtcggcagcaattgttgagattgtccggcaagtagagcaggcatccacttcttctatgtcccctattcaacagtgcttcgtatatttgggtgtctatgctttgtagctctgaataactcatcttggaggacctcggttcctttgaagacgaattcaatggcaattggctttgaataggctttttacctttacagtacccacatgaactggtacctgaataggtattcgtcagtgaaagcatgagagatgacaagagattgcaaatggtggaacagattacatcatcaggtatatgatcccaactcgcgatcagcagagtaccagcaaataccaaagcaagtttaatgtgtcatgattggggctgggaagagatacacaggaagcctgccgtatgcccataaacacacactccgccaatgcctgagtgtataagtggatcattaatccacaaaactgttatcgctgagctacgtgtctgctgacaacaatccagtttatgatgattccaatattttattggtaatattatatcatacagtctatgtattgcattgtattccgatttaccagcaaaaatatcctattagtcactccccattttgacgtcagtttcgctctcagtctctaacgtaggaatttcgaacttgcacctttgcaattcttcttcttctgcactattggttggatattgtctcaaccatttcattcttgggccagaaggtgctattttattaatcttgaaaccaaacagctttagatcaaatatctgtttgggtattaaattaactcttcgctgtatctcattaaacatattgacaaaaaggatagcaaacgatgttccgaaaaatgctccgtcaatgtgtaaatacttggaagaggatgggaggtaaatatcgttgcaacttggacagtataaccttacagtttctattccaacttggtcgtatctaccgattggcaacaagtacattccttcacaatggactcttaaacaggttccgaagactgctttctcatatttgcctgccatggcttgtaatcctggtttcgtcaatatatatcgggcgtgtattaatccataaagtaactcagcagaatggtggataattggcaagctttcgctcttgatttggtagtcaggttggtagtccaggatcatatccagggcttccctgtagaatggaacgatggaactcaatcctgttaagttgaagtcatcttctatgaattcgttggaaacctcaacaaaatactcgtgaccaaacatcatgcaatattcttggatccatggctgttcctcatcgctgccactttcctgtgacatctggtctgattctacgatgcggtttgttgtcatggaggaaaggtcagagaagggacctcgataaaattctacattcgaggtggtagataccacctttcagctcttggcaggagcttctcgagggcggagggcggagtggcagctgaaggggaattcccccaaggagagagtatttttatcgtttttatagttttccagctcccccttagagactatttcgctttcatattcaattacttccaagtgttcttagtggcaggatggatcctttttcaattcttctcacattgacgctgattatactggcccaaaatgcagttagaattgtcggcaagtcccaaatccatcagtctatatggaatttgtatcttaggtatagcaatgatcaacagatcttaaagctgaggaatcttaaagcagagtcttacgacgtttataagcaacggtctaataccagtgctcaggatgagtatgctaagtggacaaaactgaacagaaagtacgatcaattgcagactgaaattaaagctgtctcagatcaggtatcccaacaacagcaggctattgaaaagtatttgggattggccattagtgttactacaactctcccactgtggctattcagattcaaatatagaaagcagcctctcttttactttccaaaggacactttccctagctatttggagtggattctatcattcccttctgttcctcaaggctcaattgggattatgttctggattcttttgctcaacaaattcgtttccaacttggaatttattgtcaagacattttccactaaggtggaaaaacccgttccaattgttaaggtggaagatctgtctccaaagtagcatctttgatcaaatttttgtttactataagaatactcaaaatataattacaaaactcaggtccattaagtttccagcagtccattgcgaccagcccaaactagtacatccgtagtgcgatgaaaatcgtgaaatgtctcccactcaccctttttgcgtcttgttttgaatcttgacttcttaggaatacgaggatccagggacttgtatacaatcatcatttgtacaaatgcccggtattcgtcgttgtcccttctgtcttgcagagtgaaatgtttcagaccattgttgtacagtaacttatccagcagataatgaatccataataggttggtttgtggacacaattgtgaccaatcgacttcctcatcatgcttttcgtactttagtagcgatgaaagggaatgacttgacacacttctcgagctgcgtagactgcttcttttattattgctgtgagggtcaccatccttcaaattctgtctcatgagcctgtaaatttcaaactggtaatttcctcggcccttgaagaagttttgatgacttagtcctgtaaataagacttggtggggtccctctatgcgtgaatatgcataatttattagagttggcttcatgttgccatcaacaactatattgtcccagtggagatcccgatgctcaaacccgtacaggttttcggctttttcaatcagtttgactatattccaaaacagctcctttacctgagtccagctggatagatgagctttggagagattagttccaccgtagttgagaatcatcaccaagtaattttggttttcagtgtagaaatctggtctgctattgatagaactattataattatcccagcagtgcaagagttccttagggtattttccagatacgacaacgcatccttgcaattgtacaaagccttccaaattgctaagtctttgagtaatggatacttcctgaatcaagtcacgtattggggtttgatcaaattcgtccttgccaaaaggaatgactttccaaacggattgtggagagccagtaatcggacatgattcaacgaagatctcgctgtgagattcttcgttgattttgactagcttcacctgtttttggagtcttgcagcaacaaacttcgcaaacggtacaactgatttggacaacgtacaaagacttaagagatggctaaactggtaactatcgaattcctcttgaggaatggattcaactttggtttcctgagagtcaatggtgttgatagataagattgacgacgagttcttcaatttatgcttgagcttgtccttagaagacgcctgggggacaggcaatgaaatttgggttttatcgaaagaattgatagactccaaagaaactttgctcttgagagatctaaatgattttcgaaggcgcaaagtatgtgatgttgccgtggaggctatggaactagtgtcctgctcagagttaaatgaattgagcctgggtctaaagagtgatgacctcattgaaatagagtttctgagtgattgagtggaagtttccggtacaaatgagcttgattcagcggaaggagtcatccttaaggagaatcttttcttacttgcagcagatgtttgtaaggaatcggtatcatggtccgagatccgtgagtttcttcttgaatcagcagagaaactagcagtagaagatcggttaatccccacaacccctggtttacaggtggatctcaagggagtactttctcttgaagaatcagagtgcactgagactgaagtgattttgtttgcgactttttgagcaacggtcttgaaacttgaagatgaagagacagtagaagccatggaaaaccgctttgagcttcgtctcctgttctctttatcgtcaaactcagtatcctctgatgccacgctgaatcgatttttgtcacggttagtgttctgatttgcatctgagtacacatcaacttcggattgtggtgcgttcaacagaccttccaaagtcaatgaggtaaacgaacgtctcaagttggaaggatctctggatagatctttgagcaaatccctgtttccagaaggaataatgataccagcacgcctgcttcgatccattgtttttcaggatagaggcttgaaacgagttttttttccagttgggtagtgaagcgaaggaacaaagtgggacaacaactgaaagtaaaaaaaagtgcagtgaacggattgtgatgccctctatggacgttagatgaggagatcttccttgctataggtaggatatagcttggtggctgaacagaaagtgctaaatcaagtttcagttctgacctcggaattttaagtgtgcgaaatataaacacataaccaccaggaacttgacccaatttggcaggttgtttacctcacttgcgaaggcgccccagttattttctggcaaggagtcgtgatgtcgtctagatgataagaccgatagggaaataattaaggaggggagaaaattaccacatttcagactgtaactaactatttactgctcttctaagtcgaaaaccacatgcccatctgtctcactgttgtacggctctattaagtacttggagaatttcttcaaattttccaagcctcttacttccatagccagcagaggcatcttgaccaggtggtaatcctcatataactcatccatctgatcgaggtatttcttttgcatacgccatctggcgttacatcttctgcactcagagtcgtctgagaataacagttggttgatgacaatggagttgacatccatgttgtatgacattaattcttgaatcaatctttcagtctcatacaacgacaaaaactcggagatacatacacagacaaaggtagtgagttcgggatcttgaaactgtttgttcacttctgtgacctgcacctggatttctttgatcttagaagcaaaatcgatgctttgtccaccttgacttcccaataagttgttgagcatagggccaaatctgccgcttaattcgttaacctttcctagaagtttttctaaagtggatggcaactgtaagaatctaagagtatggccagtgggtgctgtgtcgaaaatgacggtgtcgtatttgatctgattctcctttgtctctccgatatgcttcaaaacttccatgaaagaaaatgcttcgtcaatacctggaatcgagcctgtgatatctcccatcatactcttcaaaggatcgtttcctccagcactaccgaaagtggattcgttgttcttttgaagattttccagtgttgaatctggatcgatctccatacaagacaaattaggcaagccctccacttgtctggcgtcctttccaaatttttggttgaaggcatcgcttaaattatgagcaggatcggtggaaataagcaggtatttcttgttaggattgtgaagggcaagctggatagatatagaagaagatgtcgtggttttaccgacaccccccttacctccaacaaagatccacttcagcgattcgtggttcacaattgatcgcaaacttggctctgcctcaatatccatggttgatgtctagttgagtggcgtttgtggtctcttgatgagttcaaggcgaaagaatatgataggaaagcatggtttgaacttttcgcgaaagaaggaatactgttccgcgagaaactccccggtgccagaaccttccattgaggttaatcggtgggaggtgttcgaatgacaatgtcagacaaggcgaacacgtcttgtgacaccagctggactaagaagattcggtatgcaccgaagaagaaggccgtgtctcaattggcaactttgcaacaaactacggaggaaaagtctcacaagcttttaaccaagttgaatcacgacgacaacgataaagaaatcctcaaccatctaacacatgaagtacaaagtagaaatgtgatcttattggacaaactagaggagctcaacaaggaactgggctggattaaagaccgaaaatgaggaaccatgagcactgggcgtttccagaaaaactgcaaccaacgatgggaaaatgataccacactactatggtcaccccacattgtgaaatttcaaaccaaaaaagatcaaccccataattccccagagggttttcccaacaattttccaacggacttgataatgagtcagatcatttgagcatattcatcttaccccttattccgtgacaatttacctattccattcaaagcatacggtatcccgtgaccttctcatggagatcattctccaccgatacagcatatacacagatatacccaactaatatcaattggaccttgatatggtcgaccttgatggtcccgtccaaccttaaaacttagtttaatgctatactttcgccttgaaccaaatctgtctccccctcaatcatctctatgcaagaaggtcaacactgattacgtgagcaacagccagcaatcgttcgagtccccgccaaaaaaggcggagttactgctccttgtgaccacaccccctgagaccacgtccctaaacgatccttgtcggttccttcgtccaattggcaattgccacgcatacgtgaatcgttattgtttcgcctaccttgcgtcattcgttccagaatgttcgacatactcctctagaacataccgtcacaccaccatcttaagttatcttcacgtgaccatgacgtacattgtagttgactaccccattctcatcattccgatgcggccaaaaatctctatataaagaccgtatcccctaatattctcttcttgttaagacattaacttagttaattcaccaattactcacttataaacaaacaaaatgacaagaacaaacaaatggaataccgaccactcccacctacacagggatgttgagccaaagtatttttcaaagagcggtggtcatcttgaccaagatccaagcaaggtcaagaagaacggccacggaaagggaaactggggttccctaggtgatgagatcaatgacattgttgattctgaggaaggattgggctctttaaacaaacgtcgaggttccaaccacagtttcaacgaggaaaagatccgcaacattcaaagctacaaagggcctggagccgttttagttgatgaggacgaagaaaccgaataaatataaagctatagagaaaatatgattgacgactgattttttatctatttattgtaggccacttcttgtttgagctgttgctctagctcgcttttccaaccctttttcctttgacgttcctcgtattcggcccgattatctaatactcggttcactattgttgaggttgtcatgtctgagtattcatactctgatagctcgtggacgagagttggatccaacaactgtgcttgggatggcagatctgatgcattaactaccacttttatcacattacctgggatcttgcccaagaatgcagtatctaatactttgggagccccaatcacaagtccatcgatgtatttcgattgcaacacacataatgatcgttctactagattcatgattggataattggcattctttgcagttgcatcgtcgtatatgcccacaatgaccttggcatcgttggaacgggcatatttttgagtctcctgcaggaacttgatatggcctggatgaaaaaggtcaaactctcccactaccaacacaaccttttggtacccatttttgggagagacaaattcatgcagagtggaagactcttcgatattgaaatataccccggcataggagtctcgcccactggggtcactcgcatagctctgcaccctttcccttatatcagttatggggtgatttaagctgattggaccctggtgatgatgggagttgatatccagcattcttcccaccagatcagtggtgctgatgtttggtgtacgtttgaccacgatgaatctacccaggtccttgcaaatttggtaacagtctttgccgtcagcatcagtggttatatcatcaccgtgtacgacatatttgcacccatattggtccatcactagcgggtctgtaacatagggagcattcggaacaaccttagtgcaccaacggcatccttctactgctatcacccgttcaggtagtttcattaccactggacctttgtgtttcagtatttcttcgtctgaatggactccaacatacaactcggttccttcctgtcttgcttgaagcattgctccggcatgcccgtgatgggcaaagtcgaaacatccatcaatccaaatgcggccttctacgattgtcatgggattctttgtatacgtagatgcaatagcgaagtggggcctgaacgtcactctggcaggacgggctagaaaatgctcctaggctgagtcgcggatattccccgtacaagtttatcatctagcaataattgcctcaaaccaggaagaccagcaaagtcactccattgtatataatggcaaacattcaagagcaggtggaaaatatccctggatatgacctcgttatgggggcatgggaagactatgcgggagatcactttcagaccaaggatccttaccgagaaaccctccccgatgggaagacacgcaagagaaagcttccagaaggcgctacaaaagacgaaaagaaatcctggaaatctatccaacgacgagcatggattgatgataaatgctttctgggttgccagccggtggattgtggtattggattggcccctgtagttgcatttttcattccaaccttggggccaattgtaatctacgttgtccacgctagattgatcaaggtggcctgtgatcagtttgatattggtcctaagcttgaggcaaaattacatgcaaatatcctgtttgatctacttatcagcctgcctcctatcattggtgccttactggcgtggttaaacggttgctctactagaaacgcagcgctgattcattcatcagttgcaaaaaagattgtacaacgtcaaaggatagatggaattgactatcacagacagtaaaagctaccgaagttaaccattcactctgccattagtgaattgttttcatagtcccgtttcggtaaaaaactatttctgtcaaggcatcgattgcctgattaggcaatcgatcaacaatcatcaaaaactaaagaatagatagaacttgacttctatcagcacctctttactagccatgtcgaccgactcaaatctcggttatggtatcagtatttcaggaggctcaaggtcaacccagtctctagggacgagcagagtgacaccctcgcgtagtgctaatcatgagggaaaggagaacaaggccttttcaatgatatccccaaaaaaactaatcaacaagttgtcaaaaagcagtgtttctagcaacaacaccagctcctctaaccatgactcatttgttgatagaaaatataaaattgaaatagaaaattcgttctcggatagatctgtgtcggaagttgaccttctggaggattcgttggatacaactgagggtgactctggtgagaacttggtttcgaccccaacccaggttactttgagaccaaaaagaggtaattcacaggataggaatgagaatagagtgcttaaagaaaaggagactgctgttagggaatctcagcgacatacgggctttttcacagaaagcatgttgtccccttctgacggctccagacaggatacttctgattctccgggctccatatcgattccaacggcggaactctctaaaaagaatctttctgatgtatctaaatccacatctgaaaactcacataacaggaaatgggaagctaggtcctcattacttccagagaatttgtcatccattcatctagatgattccccaatagagatatatgaagacgcagaagaaattatagacgaaactgttgaagagccacggtcatcaattccactacagaacgaatgggaaatggaagatacgatactagagggcagacttgtacagtctgcatctgatcccgtgataacttcaaatgacattagtaaagagctacgcaaatcaatatctacgccagccttaacacacagtgacctagtagactttcgtaaagtgataccaggcagttctcattatcacgtttttacagatcctaaatctccattcaccgaggatccctcacagttggcatatcataagatcagagaccgaaattttgatgcccactattcaaccgatcccattcggttgagttcgggatcgagctctgagggaagtgacgagaagaatttgttgctgggcagcagaaaaccatcggacccttacagattaccatacgaggatgaagacggatacaggttctggaccaagacaccactcaaccgagagtgccccaagagagtcgccctctggctattagtaggagccattctggctcccccggtatggatcatgatgtacgttggcttcttggattccagtgtgggacgccttccacctaagtaccgagtaattagtggagtgcttgcactaagcatgatcatcctcacggcgatgggaattgctgtagggtttgcatacgggctgaataatagatagagacaatataccgaattcttcagtacagattggcccacatagcctcgttcagtgatccgaccctccccggcggaataaacttgtgacctactccctaaatagaccagaaaaaaatccccagacactcttggcggattgtcctcgtgagcgagctcccacaatcaaggtcgcgaacccccgctatcgcaatattcttaactcttgtaaatgatagccacgaaggcaaaccattgatttcagaatgggaaacgtaccaaccagagaagaggctagtgctggtcgccgggcttcctcattctcttatgagcatcgtgctatgggtcatagaccaagccacccgttttcgccaccctcaatggacggagctagtcttcgcaagaaaatgaaaggaaaggacaaggatcgtaaggagaagcgtcgtttgaaggaggaacatgcctacaacctgatagtcaggcatactgaaaatgttgatgggggattcttagcgccttatggtacttaccgatcgaacttagactatgatacaaacattgtccggaacttgataatagacagaagaatcgccccattttatactcctctgcaagactttgaagatgactggtccgacgaaaaattactggagattctacgttcacttccattacacgctcctcttaccgaagattcattggcactagagccggaagatgaagatgaccatcggttgcacagttctaacggatcgtttaggaggaaggataaccagaagtttaaacaaacaatggcaaaaaagactgcagagtggcagcaggaggctcaaaggttgcaagatcgtgatcgacacattgcgaaacgttcgttaggtgcagtaggtaataatatagccctggatatcccatcagatgacctattgctacttctttataggagggcttccgaatgtccaatttgtttcctttattatcctcaattctttaatatcagtcgttgctgtatacaaccaatttgtaccgagtgctttgttcagatcaagcgacttgacccccaccctcctcatgatgaagaaggaaatgaacagttggatacgaatggtgaaccggaaacgctaattagtgaacctgcaagatgtccgttctgcgcctctatagactttggaatcacttatgtacctcccccattccggacaggtattaatgccatcccaccgtcagaattccgttccgctataactaccatagaagaactggatgagaatgccatcgaggatgatgcgccagactcatcgacaactacaattatcacagaatcaaaatcaaaagcaagggctaagaagtcctactcgattgatcctacagtgctactagatcaaggaagacatcggcgaaattcattaccacccaattcgcccagtgtgatcaccacagacactatccgagcggactgggttggcaaactagcatcggccaagtccaaactggctcggcgatcggctaccgcatcagcaattcatgctacttccctgataacagaggaggagcatatatctaacagtcaaaggagagcactacgagcagctagacaaaacgacgagatacatgaactagaagagcgtatgattgaggaggctcttcgtcttagtcttatggagaatcgagacgaagtgcaacgacgaagggcatcggccccagagtcacgcacgtgattataatacatcattacaccacgtaacttttcgaacatggaaaaaaaaaccagtgggtccttctctcttcttcaagggattagtccgcaatatctgcttaaaccgattatctctattaaacgaagatggctaccgaaaccgctttatcatacgccgcccttattttggctgattctgagattgagatctcctccgacaacttgttggctttgaccaccaaggctgacgttaaggttgacaagatttacgctgaccttttttccaaggctttggacggtaagaacttgaaggatttgttctttaacatttcctctgcccctgcctccggtgctgctgctggtggtgctgccgcttcttctgctgatgctgaggaggctgctgaggagaaggaggaagaggccaaggaagagtccgacgacgacatgggcttcggtctattcgactagttacattctaaatacgaatacacatggtttgaattataaatgatgtaccttgcctatgcctaagtggcagaaatttttgattctttaatcttttcgttttatcttgacgacaagtctaggatcgatcgatcactccttgtaaagtctaagctgtaacgatgtacatctagaagtagggagcttaagatatctggactgtccaagcatatctggccaatactccatttggttgaaaagtttgtacaatccaccaaacgaacttctacgatgtagaccactagcctactatgtgttacattactcccggattcaatatacactacaaagcgtctatttcttgttagcttcagcctcggcagcctctttagcacgcttagcaacttgaccagcatacttctggtccagtctggcctgcttcaaagtctcgaaggcagtcttctcaggaacaacgacagctcttgggccaacctcaatggctggttgctcaactgggaaggaagcacccagagagatttgcttagcatccttggcctcagcacgagacttgaagacaaccaacttagattggtactccttcaatctttggacgttcaactcaaaaccctcctcggatctgttctttcttctggtgtcgacagcaataccaacggttctagcgtagttagcgttcaaaccaacagccttaagctcttcaatggtgaatcctcttccagctctgacttttctgttgtgcttgacggttgggcatctgacaatgggtctcagagagtccaaaggtcttggagccagattgacagccttagcagctctggcgttacgtctggaggttctctttccggcctggtccaagtggactctaacacgttcttgccagtgctttctgaagtggttcttcaaaagtggtaaatttttagagatagctataacttggttagtacttcatttgtcggaaacggtatttgctagcactacgagagcatagtgcttgggtgatttaaagaacatacccatctttgattgttgtagttaacctggaagctttttttaacttggtgaaaatttgtaaaaggtgagtgaaggcacagatcgagaaagatttcgagcaggggcttcgtaaccaaaatctgaagggaaaagtgctggcgggagagtatgcgcgggtcttctttggagatgggcggacgatgctcggttccccaggtggactatttttcacaaagcaatttagtcttataatgcacgtgatcgctctagttttgggagataaatcgcgtgtatttacaggtctggccttcctagttcagttacagcagtcacaaattcgagatttagatttctttgcaaacagttatttcaagtcgtgcactaacagtcaatggctacacactaactgtttcaccctcccagtcaaacctctgaaaacgttaactcttattgtgcgacacactacctgatcgctcacgctctctctcggattgtgaaaaaaattgctaacaaaaaacttgttctttgtaagagtaacaatgtctcaagaagctaagtccgtacaaagtgttcaggtaagttcatcattaaggggattcggtgttcagaatgtatcgccgttcacttcccaagtattatcgctctttccattggtaggactcatttctatcagatgggagcactattgaagaaaatctaactaacatccatttctagacctttggtaagaagaagtccgctactgccgttgcccacgttaaacagggttccggtcttatcaaggttaacggttcacctatcactctggtgcaacctgagatcttgagacacaaagtttacgagccactattattagttggtttggacaaatttgccaacattgacatcagaattaaggttaccggtggtggtcacgtttcccaagtttacgccatcagacaagctcttgctaagggcttgatcgcttacactcaaaagttcgttgacgagtctaccaagaacgagttgaagaagattttccagtcatacgacagaaccctgttgattgctgattccagaagaaaggagccaaagaagttcggtggtcgtggtgcccgtgccagattccagaaatcttaccgttaatctatatattgtgaaatatatgttagaaaggatgaaatggagttttgatactctggttattgtaggaatcttgaagtgattcaagatcgctgaaagcgtatgtctgggtgaattttctgatgattctaggggtactggtgatagtcgatgatactggttgattctaatttcactggggctggtcaaaatgcacatatcatgatctttcttgaaacaaaatagttcataatagacaatgtttagcaaatccactcatcattgccagattagagacctcaaggactaactctcccactattcacatgtcaagtgtacaatactactcaacaaaatttgttggtgcatatttcatcgaaatccagtcttctatgacactcataaatgacaccttgaaattgatgattaccacttatggcactaaaacgttacttcagaaatgctcgctattcaaaacgtctttcataccgccacttcttattataacccgtctacctgctctcagtattctgcaatgaatattcacccacgtaacctccgcatcttgattaatatcacccactgactcttctgcttatataatcaattgcactatcgcggcagagtcattcctcatgatccatataagtttcaataattttcctccgctactgaaattaaccaaactacccacctatccaaataaaatgtcacactacgctttgagccctgagcacaagcaaatggttgagggccatttggctgaaaccgatcccgaagttaaccaaatcatcaaagatgaggtcgacagacagaagcactccattgttttaatcgcttctgagaacttcacttccacttcggtgttcgatgctctcggaacccctatgtgtaacaagtactctgaaggttacccaggggcaagatactacggtggtaatgagcacattgaccgtatggaaattctgtgtcaacagagagctcttaaggctttccacttggatggaagtcgctggggagttaacgttcaaactttgtctggttctccagccaacttgcaggtataccaagctatcatgaagcctcatgacagacttatgggtttggacttgccccacggaggtcacttgtctcatggttatcagactgataccagaaaaatctctgcagtctcgacttactttgaaacaatgccttacagagtcgatctggaaactggcattatcgactacgacatgcttgagaagactgcagttctataccgtccaaaggtcctggttgccggtacctctgcatactgtagattgatcgattacaagagaatgagggagattgctgacaaagttggtgcatacttagtcgttgatatggctcacatttctggtttgattgccgcaggtgtcattccatctcctttcgaatacgccgacattgtaaccacaaccacccacaagtctttgagaggcccacgtggtgcaatgattttcttccgtaagggtgtccgttctgtcaacccaaagactggtaaggaaatctactacgaccttgaaaaccccatcaatttctccgttttccctggccaccaaggtggtccacacaaccacacaatcgccgctttagctaccgctttgaagcaagctgctacacctgagttcaagcagtatcaggaacaggttttgaagaatgctaaggctctggagaatgagtttaagagacttggatacaagttggtttctgacggaactgactcccatatggtccttgtttcattgaaggataaggatattgatggtgccagaattgaaaccgtttgtgagaacatcaatatcgctttgaataagaactccattccaggtgacagatccgctttggtcccaggtggtgttcgtatcggtgctcctgctatgaccaccagaggtgcttctgaggaagacttcgtcaagatcgctaactacatcgacaaatctgttcaatatgctaagaaagtccaaagcgagttaccaattgaagccaacaagcttaaagatttcaaggccaagatcgctgaaggctctgacgagatcactcaactcaagaatgagattagcgcctgggcaggagaattcccattgtctgtttagaatataattagtgaacaaaagaatataaataaattactacaactatttctctaactcctccaaggtctccttgatcagcctgaaaacaatatcaacatcgtgtctatcttttccaacagcagaaacacccatgtgcccaaccctaaagtattcggtagcaattccagcgtagataccagtggacagggtcactcctttttcagaaattttcttcaacaaatcaggtccattgatggacttggggaagtagacggcggtcagcccattggcaccaaattccctcttggcgacaagttttagtcccaaagactctaagttgtccttaaacttgttagaagtttcggcgtgcttggcaaatctgttgtcaaggccctgctccaaaatctctctgagagatacacggtatgcgtgaatcaactgaataggaggagtggcataataggcacccttaccatgttcatatgcttgcatgatcggaatccatttttgcaagttagcgtagtaggaagtaggcctttttttggcgaaggcctttttaactgctctctctgaggcgatggagatggaaagacctgctgggactccgacagctttctgagaggcagttaggacgtagtccaaaccccagttatcaaattgaatgtcttcaacaccagctgaacaaacagcatcaactacaactaaggcctcaggttgaatggagcggattttttttgcgatagcctcgacatctgaaataaccgcggaagatgtgtcgacatgagtaattgtgacaacgtcgtaggactttgcagaaagagccttctccacctcggagaggggaacagattctcctaatggagctttaacgacgtcgacatcagtttcggtgtaataactaagggcatcagcgagcctgtccgaaaaaaaaccagtggaaaagaccagagttttctctcctcggttgaggaagttggcaccgactatatcccaacccaaagaaccggaagcagaaattactataggctgtgaagttgggttggaagatttgaacaacttacgggtattttgcagaacttcttggaaaactggaataaaatctggtgaagtatgagcctgacttggagttgacatggcgtccaacacatcatcgctgaactcgattggacccgggatcatggtcaacctgtgagcgggttgtttggaattaggaatagtgatggttgacatgcttctgataggttgtacgaagcgctgaagtttggagaacattgagatgagaagcgggtgtcgttgaaatatcatctcgcgggtgtttgggggtctgactctaaactgcaagcgatgatgcgatgatgccgttgatgatggatcgtgtgaaacacgaccaataagctttttttttcagtagaacaacctagtatatggtgacccccactatcgtttcagctttgcctggattctttggaactcttcttcgtcaatatctgggactgctgcccttttggtaccccgtttcttacctcgtttggattttacctttgcgtcctcttcggtttccagtttatttatcaacgagtccaacttttgattagatgatcgttgtttagcctgaataattgactgtagtccttgcaaggttgaaatatcctgatctgctttcttttgcttcgccagtttcttctgaagcttttcagcttcaacagcctccttttccaatttgcgcaattgtctctttatgaaggatttcctattgtgtttgtacttgtcccatttatttgtagtttcaacctgtttgctgtctaccaattctgttaccaagtggaagatacgttcttcttcactctcgtcaaactcgagatgaggaatggcctcaaagagctttggaacgtccatttcataaaattggagagcatcaataatatcttgcttctcttcatcacttcccttgtacttttctctatcttcttcaatcaaatcctcagtgactggctggcttttcatcgtctcaaagtactctttccaatcgaacccatcttcgtctagggcagtgtcatctagtgaccctgtactgtcgtatcttttcctccttttcgagtcagagagaattgaataagcaaactggatcttttggaaatgttcgtcatttgatgagtctgatccagatttcttatcaggatggtgtatcaggcataatttgtagtaggactttttaatttccacaggtgtagcttcattgttcacaccaagaatttcgtatggttcaatttcaaaaggaacagccatgctttaggagatttctaggcaatgtttttgggaatgcaataagaacagttggtgcaacgcgtcctagtgactttttctcacccgtccattgtgggggtgcgcacattaccgagtgacaaaaatgagcttaatactcacctttgcaaactaccagaagcttgcttcctcactaggcaaactcaccttcatctaaactattttcaaaatggtgcataaggctgaatacttggacgaccacccaactcagatttccagcattctttcaggaggttacaaccacccattacttcgtgaatggcaacatgaacgtcaactcaacaaaaacatgttcatctttcccctgtttgtcacagatcgaccagacgaagaagaacttattcctagtctacctaatatcaagaggtttggcgttaacaagttgattccttatgtaggaggtttggtttccaaaggattgagggcggtgatcctatttggtgttcctctgaagcccggtgtgaaagatgaagaaggaacggccgctgatgatccagagggacctgttatccaagccatcaaacacttgagaaagaactttcctgacctgtatatcatcaccgatgtctgtctatgtgagtacaccagccatggacattgtggaatactatatgaggatggcactatcaacagagagctctcagtccgtcgtattgctgctgtagctgtcaaatatgctcaagctggagccaactctgtggctccttctgatatgactgacggcagaataagagatattaaagaaggcttactaagtgcaggactggcacataaaacgtttgttatgtcctacgctgcaaaattctctggtaatttgtatggccctttcagagatgctgcaggttcctgtccatctcaaggggacagaaaatgttaccagcttccttctggaggaaaagggttggcccatcgtgctctgattcgtgatatgaatgaaggcactgatggaattattgtcaaaccatctacattctatttggacattgtcgctgatgcttatcagctttgtaaagactatcctatctgctgttaccaggtttctggagagtacgccatgctacatgcagcggcagagaagaatattgttgatctgaaatcaatcgcttttgaagctcatcaaggattcttgcgggctggagctcgtttaatcattagttactttacccctgaattcctggagtggttatctgaatgatcgttcatcgactctgtattacttgtacatattcatatacaccgattgtatatttctacagcattatatattttagttgtcctcttcggcgtccttgttatctccgtgtggtccacctgtcgtcttactccagcccaatcgacggttcaacctttcgtacttttgtctatctcggtcactcacacttgggttgacactatccagtgcagtttcaaaatctgatggtgtaaccatgatttgttccgagtctgatatgcagatatcttcgactccttggttaatctcagtgaaaaaccgtcttttcaatgaaataacaccagcttccctaaccaacgaagacaaatcggctcctgaaaaattacgacatctttcgtcgtgtgcaattgattcaaggttgacatctgaggaaattggagttccattcaccctgatcacagtcttcattatttctaatcgttcatcagccgtaggtagctcgatgtataaggttttatccaacctacctggacggagcattgcaggatcaatcatatcaggtctgttggtagctccgatcacaaagatgcccttacggtcattcaatccgtccagttcggttaacagtgtattcaccactcttgagctcgactctgataatgaggcatctctacgtgggaccaaagcatctaattcatcaaaaaaaatcacacatggaattgatgcccttgcacgagagaaaacttgtctgatagccttctctgattcaccaacatatttattcaataattctggtccttttatagaaatgaaatttgcctttgactcattggcaactgctttggctaaaagggttttaccacaaccaggaggtccccacattaaaacaccagcaggggcagtgataccaactttctcataaatttcaggtcttttaataggctgaacaatagccatatgtaattctaccctggtcttggatagagcacctacacttttccaagtgacatcaggcaccgtagcaaatccctctcgtttggcggttggttgaatagtgggtaatgcagtaatgaaatcttcataagtgattgacaatggagccaactgttcctccgtcagaggatgaggatgcttaagtagaaacttttgaatagtcgagaggtgagttaattctctggttttgtctgtgattccctcgtctatgtccatggtgtcctcatcttgcttttcttcctcgtacatagcttctatgaatttcttttcctgttcttgactcaacgtgctgaagatccttttaatagcggaaattccagctgcgctaacaagtgctttgagatccgcaccaacatatcctggagtcatctttgcaagtttcattaattgaagatccccgcttgctttgatagttttcatcattgattccatgatgttataacgagctaactcattgggaacattgatacagatctctctatcgaatcttcctgcccttctcagtgcaggatccaacgagtctggcctattagtggctcctattatgattaccggcttaccatctgtcttatccagtgataactcgtccatagaagtcaacagttgggctacgatccttctttccatttctctttgggctccgccatctctctttggcgtaatagcatcaatttcatcaaagaatatcaaacaaggggctaattctttagcctcttcaaagattcctctgatctttttctcgctctcaccagacataccacttaccacagaaggggcgctcagtgaaataaagggcacttgaagctcaccagcaagggcattagcaatagtcgtcttcccacagcctggtgggccatgtaagagtacacctctaggagggtgtatacctgtagcgaggtagatttcaggatgaagaattggcataccaaccacttccattagttcagtaatgatatcgtctaatccaccgagttgtgatagcgtaagggaaggcggtgttctgtctttacttttgattctcttgttaggcttttcagagtcttttcctttcctctttttctctttcttatcagaagtctcagtattggcatcgttttcgtcagatttctcctcagatttgtctttttcgtctttctcatcctctttaggcccagatccccagagaccaacaatacttctgttcatcgaatttgtgtctacgacctccatcaggttcttttcggccagaaatgtctccttgtcgatttcttcatcgagtcctagacccttcaactcttcggactcttccagtttgatctccttccaaactttctctatggccttttctaaaatgaatttcttggtcctcttcaaggagaaatcagatccttgggcatacagtaaaatttccgatgcctttaggtctctagctaatactgggaaagtacttgcctcctcttggccgttcttagcattcttgatcttcagacgttctgtcttttcgtccagcagtttggatatcgcattagtgatcttatcctccaagtcctttgatatcacaatgggtctggatttagccatgctggttgatgtagtactaaatttctttacgagattactttttatttttctggccccaacaccgcaatgactaggggtgaaatctaaggggtatacatgtatttcggagatgacaactgatctgaattgtagggagggaacgatatcagcgatatcttactattcatagagatcagttattaaagttttcggtcacaagaacggctgggagcagtattattctactcatttttccgtgaacagtttaaggatcaacttgatctttaaggcgcgaagaaggaacatctaaccctgttgcttacctatccccagacaagattcaagtttatccttgtccgcacacaatgggaaattcggggtctaaaggattgtcggagcaagacaaggccattttgcaactcaaattgcaaagagacaacttgcacaaagcacaaacaagaataaacctagtcatagagaaagaaaatcaagtcgcacgacaactattgcgaaatggccagaaagaaagagcaaaactggctttacgaaagaagagataccaagaaagtttgataaaacaggtttttggtcaaatggacactttggagcagctgatttcaacgatagagttcaagctcattgagaaggatgttctgtacggactacaagagggaaacaaggttctgggacaactcaacaacgaaatgtctctggacaaagttgacaaaattttagacgaatcagatgaagcaattagataccaggaagagattactgatctcttgggtactcgtatgaatcaagctgatgaaactgccgtagaagaagaattggaagccttggaaagagagactaagaaaacggttgtactacctgatgtgccaactgtaagggttggagtagaggatgataaggaaacaagaaacgaacaaaaagaagataagcctttacaaacacagaaaactccagttgctgcttagtcaattgcaacttctattattatttattaatcaatctacttggcaccatggctgttcctcagaatatttctccggaacctgagttctttggatcccttacccattcttttatgaaaggttacgtatggtgcggcaataatttttccattccttctagcaacatctgtctggtcacatatcagcttgggtgctatttctcctataggtatttcggttcttcctcttatcaagatcaacgtttggtccgatgaccgggcaggggtcgaatttttgggcatatagacattgaataccttccgaacaaggtcaacggagtgaatgagggcatgaccaaagaaatgacagccctccaaatcgtaaagatcatcaaatgctgttgagaaaacagaatcagagacataattaggtaaacctttagtaatggatacgtttcctgaggagaaaagatcttccactttcgttgctgggactgagtacacggctacgacgcagccgtccaatgctccagggatatcatcatgatgcaattcataggcatctagaattgtaacaaaactgatggccacaccgtcaattagagcattatcagaaaaggaaactcggtacggagctttatgcaataggggtgtaaaattatatcttggtagtggggaaatttggtggaagtattgaagaattcgtaaacttctcaaatgggagggtaaagatttggcagtattatagttatggacgccagttatctttaaaaacaattctgttcgcaaactgttcatcagctcattctcttcgtctgaatcagggtatgttaagaagattacctgagtgggtttgataaagctacacatgtcttttagtaactcaatcccaaacccttttatccagccaggtgtatttattaataatggtaagttcttcttgtgtaagtgacaccaatagtagtttgttaatgctttcatagctgagatgtatcttgtgggttgcctactgggagatgaaaatcccgtataatgctcaactaaaagcttacactggtgcatgttcataccaaagataggagagtcaacctctgacaaacttatgcaatcttgggaagagaactctggttgtccagggtcaatgtccatcacgttcactgtggttgattgtagtaactgattgattaaatttgtcacgaaagttgatttcccgctgtttttggttccaataaccaagattctagatccttttgtcactgtgttcatagccaatttccactggtcagatataagtgttcccgatgtacgagatttttggggtggtaagatgggagtgaatgtgtgcccatagaattttgcctcgtatggagacagtgacttcttggaatccgaagaaacgaaggagaagatatttcttagtggtggtagcaattctcccacattttggagacctgttgagtaatcccttactaatatcactgattgaaagctctgtgagagcacacttgaggcatcatctgaatggacagattttattactgggagagccttaaacattggagcaacaacatttactggattagatcctgaattcattgaaatcccgttcactattacagctcctttttgcacagatagttcgtattgacctccaagcaaaagatactcctcttctttcaaggagaatcgcacataagtctcgccaaacacaacattttcttcagtaactgtgaagttggaagtatccaaaggttcaagagcagatgtctccaaaaattcttgtatctgaaactgattcaacgtatcggattcctcggacaagccgttggtaatctcttcctctctggggtctgctgaatcattcaactctaaatctggagtatcgtcccgagatgtgggtgtagggtgattcagagctgcaaacgcactcgcttaaaatgttagtacacgctctgttccaaggagcaggtattctgctccactgctgagtgacacacatacatttgctacccatttgaagccccctaatctttcaaatatctttcaatattgatagtctaaagattcagatagagatcacgtgcctcatactttctcccacacaactctggagtagtgcacgacttagtagggccaatcagatggtcgagatgtcatgtcagaccattgaactacagaccaagcctgaaaaatcaagcttacaacctcaagaatacacatacaatgtctgaaaacatcgagttaaaaaccgtgggctttgatgctcgtttccctcaacagaaccaaaccaagcactgttaccaatcataccttgactaccacaagtgcattacagttaagggtgaagactttgcgccatgtaaggtcttctggaagacatacaactctctgtgcccaagtgcatgggttgaagaatgggatgagcaaagagaaaaaggaattttcccaggaaacttgaaagtttaatccacagaaacctttcagacaggataaaccagaccatgtaccatgtttacttatttatttagactggtgattaagcacttaaattatactaaattatactaaattaacttatattattgtatggttacattgctgtgttgcaagagtttgttttcagagaagagagcgtcaatggttatttgctcttttggaagctccacccgttcattattaggccctggtcttgtgatatggaggctcctgagcgggcaaaccttagatataccgttaaaattggaacactgatcggtttctcaacttctagaagttctttgtcttgtttcgttaggggattgttcattatttctgatcttcttgatgcatcatcgtcaaccgatttgtactctgtggagggagctcggctgggtttgagaaccctgagataatctagtttgttgtattggtgatattcaacgaattctagcgtaacattgctgtctccaataatggtatctgaattgttttcattttgcaatgctttttgtttgattatttctaggatggtgaacattttttggatattttcattctgggctgtgagaacaatggagtcgtcacctcctattagtatctgtagtagcctgtctaaggttttcttgacgttagcattttttttgattatcaaacaattagtatctgggacccttagcttttggggtaaactttgactcatttgctcaattgatgatatttcaaacttcgaagagtcgtccattttttgtcttttctttgaggattcatatcgggacatctctaagtcctttgaaaccaaaggagaacagacgtatttaattaaggaggagaggttgtgaaagtcgatgtataccacgcaattttttttttgaacgataacgttcgctgggaggtgcattcgaataaaagcttagtaggactaatttcctcaacccaaaaaggacacgcgtaacatcaaatctagcttgataaagagattgactacttggttccctcatttactcctctccttattacttgacctctgcattttcctcaatgacttcagctctttccacttgaccaaaataattgatcgagcgaccaactcgttaggttcacagccaagttcggattgaatgaattttggatcaagtagctcctcattctttgtaaccccgtatagttttaaaacccctgccagttttctccatttttcaagaccccaggtgtccaattgtttcgctctagttgattcgtcaagagattccaagttttgcttattcaacgccctctcgtcatccaagccacttaacaactctccctcaccattctggttgttggatgagctatcaaactccaacattctactattcatgctcacatatgtatcatcagttgccttctcgctcaaaaacgtattgtttggaataactctacgggatggtcttcctaagcgagtcttctccaacttcttggagtgaatgaagctccgagccttggagattgtatcggagacatcgtattcagaaaattgaccatttagatattccttttgcgtagaatcagaacctctgttcgctttcacggtattcaatccactgttgagcgtgtttgaggaagttctagatcgtttgggtctctgttgattctcacttgactcatcgactccttcataattagacatactctgaaaagtcctaactcttgctctcaagggagtgtgtagtatgaaatcgttttgtggcggactttcggcactcaaactttgtgttttagcagtaacttcaggcgtcttcttaggtcgaacaattccgtcgaaacttgttagttttgtagctctaaccggtgtttcattgttgaattctttggcagttttatccattgttggatattcctcatattcgaagtctgtgtctcggctgctgatatcatcatcgatgctgatcagatcagttaatggaggaggacttctcttgggttcgtccacaggaattgaatgggcatctttcgattctttcggcggactcttttctggcgtatcttgttttgcaggttgaggtagtggtggttctctctgaggcagtttaatagggctcagattgttgcgcatagggtcatccctaacttctgggggaagattttgttgaaaggcagcagggcgccttttgagacccttgtgcttaggtgttttattcaacaacattattggatcattgaaatcaccctgaatgctacttgttaccttgaacggtgatatctcaaacttggggttcttggtttcaccattggtttccgtgtctttttcctgatctttcttcaggatatcaagttcaggctggggataaagcatggcttttacaatattcaaatgggtattaagaacagcagccaaatatcgatttaacctcagttgtgatacgaactgtgattgttaattactggatttgtagtgatctgtgatgttgcaagcacgtctgaagcttatgtaaaccaagttactacaagatcaccacagcaaaggtcgcgtccttctaaaggtatcacgatgtcggatgttgcaagtacgtcagaaagaaaaatattcaagattcccttccacattaaactaatatacatatggccatcaaactaatctaattttacttcagtatcttcgagatccttttcgtcttcccttaaacgcaactgttcggtagtctcagcatttttggcggcttcacgttcctcacgggctctcttatgatgggctttcttatcttcaccttctctggtttcagtatcttcgggcggtggcacgaaccatggaatcttacccctgttgaaatcgttgagcacttgcttggcaatactggtttcgtcaggctcgcctcctttgagaagtcttccgtattttctggctagaatctcaaggaaatcggtagtatcctcccatccactgatctcatatgtcctctctatatgttgtcttttacaacgcttcagaacactaggaataaactgttcaggattagaaacgttctctactcttacaacacctcgtagaagaatgtctgtctcagtatctttggttgatggtggcacaataccaggacaatcaatcaggaaaatacgtttcatcaaggtgatatactgccacaccttggtctctccgggaatgggagccacctggcagaccttcttacgacgcaatgtgttaatgatactagatttccctgtgtttgggtacccaatgaaaccgacagagatctgtttacgatcttgatgcaatactgaaaactgtctcaaaagttgaatcagagatccttttccaaatgagtttgtaattgaagcatggaatgccaaggttgggtgaaatttggacaaatgcttaacccatgcagcctaaaaatgttaataaccgaaccaattatgaaaacaactacgagtaaaggggaaaaagaaaaaaaaaaaatgatccatcgtggtttgaggcaacaaagaatgtcaaacactttactacgagcacctccattagaagcctttcgacggagggctcaactcataagtgaatgaatatcataagaggaaaaaacatcctcccgctgacaagttccaagacggaaagacagcactgatatacatttatcttccaatcctgtaacagattaactcaatcgtaaacgtttacaacgtaataagaaaatcctgactagagcattggtgtttgaatatctccatttcttgaatgaatcactcagcttttcacttctcccttttacttttcgtatacttactgctacccatgtaggtactaaatcacacttgttcaaaacaaaaatcagatgcttatgggcacactctttcttaatatacttttcaattacttcacaacgtgttccgagtgggtctctagcatccaatacttggatgacgacatcagaagagtcaataactttataaagttcattccagattcttttagattgtcccttgctgaaaatggcttccttggcttctgttgaaacaccatcttcttcgtcattctctcccataagaccaagagtagaattcaattccagttgctcttggtatttaacatgatcgccatcagttatggctgccaattcctccaaagaagaagcggcaacgttagctttctttctttgagcttttggaccaaaagtcttttcatacgattcagtctccagaatattaggtctagcagccttggtgtcatccttttcttccaacaaggacattggtaatttatttctcttcaaaagtacttggtaagaatcatgttgcttctctcccaaagcatctctgaaatgtgtcaatgcgtcttgggaaataactcttgtgtttccaaaccaacgtctatttggatctaccctagcagtagggaccttagtgtcttgcaagtaagctgccttgataatatcacctttggcattacgaacggcccggccctgtttatacatgttcagatgtttcaccttcttggcatctcgatagaaattctcacccttgacacgaagattaccatctctaaggtcattctccttaactcttctctgcttctcttttttagctgtacccatagttgaggaagatttgttagggaggaaaaaatttaaactcgataaaaaaaaataaaaaggaaaaacttatcaataaggttaccctgactggggctataaatcatgcatatctatctgactggagatcatttctcctcttgttcttctagtttactttagacaactattttcaggcactagtagcaatgtcttgtgaacacgaacatcatcagcatgaggcgccgccaattgaaacttcatccgcccaaagtttgaatacccagatcgatttcaccaagcttacggctctaaattgcactacccctaactccaaactatatgagatttttatccatgaaggagaggaatccaagatcacactttccagtgactgtgataaccaacttatattgaatatccctttcgtttcttccgttaaactatattccttgatattgaaaacttcacccgataacgatcattgtccaaaaaaaatctctctgttcaagaatgcggatgtcgattttgaaaccacggcgccgaaaaatacacatcattttgaacagcctctagttggagagtttgttgaacatcacttgcctcgtcgcttgtttacaaatgttcataaattgactattttcttcgaaggaaactggagcaacgatgagttcgaaagtttggagatattaggaatagaattacgaggtgaatgggctccgttaactaaagatccgattatcacgttatatgaagcagctgccaatcctgcagatcataaatctttagcacaggagacccaagatagcgccacttgctaggtaacttatacagctacccattgcatactaatacttactgttattccgttgacttttattgtttctacttttaaacgtgaagttcatgcagatccaaattcattcactacgttggcaagctcattctctgaactaagcccaccagattctaagttttcagagcaatggacaacaggtgtatacattccgtaaccttgctctgggctgctggtagccaccgatattttgtcctcaatatcaaattgacatagtggacatttagattcttcatgctgtgttatccattccgaaatacatttggtatggtagtagtgactacatggaagtgtttgcacaagatcgtcacattgaaattcttcgatgcacactggacaacgatcctcattggaagatatttgattaattctgtcgacaattgttgggtgaaccatgctgatgttgactggctgtttacctaggaattgttgcttgactccagaattttgagcgtacaaattatacaacgtagatggagttggataaattgtcgtgaccacagattggttatcattattgtctttattgatggtggagtactttagttcagctgttttcaagaatagagatcctgggatatgcgacgaaatgtactcaggcttacagtttgctccgttgtgggagccggtcaatccttcgatatcgtgttcgtgtttctgttttgaggcttcacgcatgcttgattgcttaaaaaggtttttactccaagttttaaagaagtgtgtagtcttttgcttaaattctccctcaaaggcgaagaagttaatcagcatactcatcaaccacactaaacttgccaaatataggctaaaaatgcaccagtttacaacattgcacatataaagaattttgagcggttgtgggttcatataatttgaataagcagcttggttgaaagacatattgatgataatagcagagttgatagagtcctctgtgacatgcggcatgaattgaataggtggaggaaaataggcgatgcgtgtgcggctcgtgtctaattgtttgcgcggctcgtgttcgctctttcttacatgtaggattctcgagacgcgtagcacgtctcctaccaatcctatccaacacttgggcaagttctctagactcaaggagataatggtttcatcaaatggcgtgtcagcgacgccaatggattctgacacggatgctcttgtaaacgggcaagttcttagtgattccagtgtgtacgggccaacctacatggacactagccttttacggttgattaaacagattggaacagtgctaggggacaatgatgaggatacgattgatcgtacgctttgcaatgggaccactaaactgaagaatggtagtaaggtaaacttcaagcaagaaaccccttcaactgagtacaatggtaacgccaatgaagtatggccttcgaaggtatccgaggagataacaactgagttactgcttgaattggtgcaagaatgtcgccaaacaattcttcagctcaacttgaacaaaaatttgaatgaacttcaagccaagatgacaacggagcagctacacatggagaatcaaattttaaagaaatcgcttgaaacttttacggaaagcaatggacgactaaagacggagataaagaatcttctgaataaaaaagagaagctagtgaattatgtgcgcaagctcaaaacggacaaaaagcatcttaaagttgagcttctacgacagagccagcaaatgaatcaaatagaggaacacgtcaacgtatctagaggggatatgcttaatactcttggtattttggcatcacatgtcttggaagatgagcaacgacgggatttagatgaaaccattgaagtgtaggacgacgatgacaagtaaactatgaagtgcaagacacagatacgattagagagacaactagaacgaaccagagacaagcaaatgggtaaagttcaaagttacaggttacacactagtgaatgttaggatttagttaagtttagttcaactaactggaaacaaagtacagtattattcgatacttgtagacattcattatctggctaccgacatctgacatctcaggtattttttttacttacatcatccctacaccttctcgcccaccaataaaaactcaacgaaacatcaaaccatcatcaaccagagatgtacccagtgatccaaagtgcagccagacgtctgggagtgcgttgcttcagtggcactacttctgtgcgagcatttaatttgcaactggagaaagaaatacgatctaaaatcgactctttgcccaagctaaacaacattttccagaacgctaacggctcggtcagacagccatcagacactgagctgcagaccattgctgagctcaacagtcttgttaccaatagaaaactttcattgacagattacctgttccagaatgcagctaaccaagctttgtacgttgacaacgaagccgatttgaaggagttggatatctcttctcgtcaagttgttgataaggttcctttcaaggatgccaaaaccggtgaaatcaagtggaaagtggtcagagaaaatgaaaatgaaggttgggaaaaaatcatgtacgttggattcgtaccaactatgattctgatctttgcaattgtactcttcaaagatgacaaatccattgatgaatgggctatggacgagcttttgttgagattgaaagaaaagaaccttagtgatgtagagctaatcgacgagctggacaaactttcgaagtcccacgtcggaaagattggagccagtgagattaacaagagggacgcggtcatcatagaaagaatcctgaacggggagtacgaccaattgtccggcttaaagaagaaagaacttccaataatcgacctgtagcgttttgacagacaaagtatttatttattgaatgatattaagaattactaaacccttcacctagccgtcgttctttggctcgtatagctttagcatgacagatctggatcttcgcatttatccttccactgacttccgcatagacgggtggcacggttgccttcgcgactccttccggtgactcaggatcgcgacagaatgaccattattacctttcattcctcttaaatttcctctctcattcttgtactacgatatatccttaacacagcaagcagaccaaccagatgaccaagtccccaactatacccaagaactccatcccctttccatcatctccagagaagcttacagtacccccagatttggccaccgatcatcgccgccgccgaagctcatctataatatcgcatgtggaacctgagacaatcgatgtcaagaatgaccaagacatcaatcccaacctaaacgccaactgggtacatttcaaaggtgcgtggctagtgcacatagtaatcattgttttgctgaagatcttctacgatctattcccgattttcagtagagagttgagctggacattgactaacattacttacgtgatcggatcgtatatcatgttccatcaagtcaaaggaacgccgttcgatttcaacggaggtgcttacgacaaccttacaatgtgggagcagatcgacgatggggctcaatatactcctgcgaaaaagttcttggtcggtgttcccatagccctatttttgatctctacacattactcaaactatgatttgaatctgtttattttgaactttatcagttgtatgattgttgttattcccaagctgccatcatctcatcgtttaagagtgacactccctttttttagctgagtatataagtagattctggaatatatggattagtggtgcagtctgtgttgacgtcaacctatgaacctgggtacatgccgacccactagcatttggaaggagggtcactgcaatttgcggcgagggtgttcacctggcctttcctttgcgcttccaagcgcgactcacccatcaatctcatccactgtccttcgcttcttcctcctctcacaccagtcgtaccatgcaatcaaatccttacatgcccagctcaagcatgctgatatcaccgcaggtacagaatagggcactccagcagcagctcctccagcaacaggttcttcaccaacagttcccccagcagtccacaggtatcagtagcggcctatccccaaatactcctatcagagaagtttggagcaacaatctgcacaacgaaatgatgctcatcagagagctggtgggtcaatataactacgttgctttgtctgtagagttttgtggtattgctggtcgtccaataggaactttcagatcgatccacgattttcattatcaaaccatgagagttaacacagatatactgaatattgtacagttgggacttacattgtgcgacaaagatggaaaaactccagatggagtgccagcctcgtggcagttcaatttcaagtttgatctagataacgaaatgtatccatatgacagtatagacccattggttcaagcaggaatagattttaacaagacgaaagaatttggtattgaagtatcagaatttgctgaactactcattgatagtggtctattattgttacctgatgtacactggattagttatcatgctggttacgactttggattcttagtttcatgtctcactaacaagttaatgcctaacaatgaaaacgactttcaatggtggctcaacacatattttcctaattgctacgatatcaaatacattgccaaagttttgagatctaagactaataatggaaacgctgcttcgtccaagctctctttggagttattggccgaagaactgggaatcgtacggccagggcaattagcttatggaggagccattcaggtgggaagtctcgctgtactcacgagcttgtgtttttccaagttgaaaaagatcatgggtgaaaagagttttgatactcagaagaacattatattcgggttccataatctgggcaaggaggtggacgaatctgtccaaatgtccaattcgggcaacggtatagacacaccaggtgctcagcatattcctcttgttggagagacgctgcgaggtgtccccaactattacaggtaaactacagctttgggattttatacgtcttggtgatgcaaagttaattatatgcataataataagtatgatgtaagcaagatctctggttcgatgtggtctctgtcgcccgttctgtcaccagatttcgtgtacctaccgattgcaaattttgaaaagttcatctttcaagactctcaacggcccaacaagtaaaaaagagatcaacactaagccgtgagtccaggcttcctgattttatcaacatggctgaacaaaaactcacttccattgcgtatgcatttatcaagtattactactcgatcttgaacagtgacaccaagaatttgaataagctttacaccatcgacggatcgctgacgcactccaaccaaacggagcctttcaagcctgctcagaaggtccagggtaatgaaaagattaaggattattattccaactctgtgcttgagggtgcctctgtaatgatctccaccatcgatgttcaaaagtcgttcaatgagtcaatcttgatagtctgttttggtgaaatgtcattgaaggaaaatggagaactatcacctgcgcataaatttgtccaaacatttgtcttagttcctaccaagcaggatatatacgatctcagcaatgatcttctacgttttattcccgacgtggatgatgagattcccgccacagaggctgagagtacggaagaagttgacgaagccaagacggaaactgcaaccgaagggtctaccaatggagaagtcgaagttgcagaagaaaagccggatggagttttctcgccaaagattgacaccaaagcttcaactccagagactgttgatgaggagcccaagactgcaactgaaagtgagacgccaaccgaaactcagaaacctgagaaacctgaggaaactgagaaaactgaaaaaactgaaaaacccgagtctgatgccattgatgctactacaaaaaagtcagaaactgtcagtctcaaccctaaacctttgagctgggccgataagctcaagtctgatgataaatcatccaatgctagttctacccgcgtaatcgttcatcagaaggataccaaagattccaaaaagcccaagaaatcgaccaccaaccacaataataccaatgacaaagaaacagaaacaactgagtcccaatctattggtactggtaacaagaacactaagaaaaaagttgcatcagccaaaaagaacaactctgatttttatccaatatacataaagggaattgaaaaggatgtgactgagaaagatctaacccaagccttgcaaaaggcattcggtaaagttgaaacatgtaagatagacagattgattgccctagtggactttgctgaagcctcttcccagaagaatgcaatccaggccaagactatagaggttaagggacatgtcattaagctggagcctcgtaccaagagagacaataaaccctctcacaaaaagaagtcggccagttcttctcaaaagaaagtaagtgctcttccggatagcgatggtttcaagaaggtaggaaaataatcttaaatacagagaacataggaaaagaacagaaagaaaaaaaaaaaaagagaaactagggaaaattggtcaattatagaggaggtgaactttctctagacatcctggcgctatgtagtaataattaatagattgcatactctatcctgtgaaaaatcatctcaaaagctcttctaaaatttcctgtttagtgtctccgtcgttgtcttcaactcttgtcaaacccaattttttgagaacatccaagatctttggtcgggaaaagcccatgttctcaaacatttcaatgctagcaatctcgataccatcgatatgagtcaccttctctactttggtcttcttccgattattctcatcctgctctgaagcctcattcgacgaatgtgactttccatcgtcggggttgcctttatagtcgggattgggagcatacttgaaagtccattctttagctgtgcgatcaaactctctcttgtccttcagaaagacacttgcaacctgtgcgtcctgagggtcacttggctctggagattgaagaagggactgcagagagatcagggtcgatttaagtgtgagaataggcgtccaggcattcttcaatatatcgaggcagattgctcctgtaacactagaaatattagggtggtatatcttggaatcaaattggaccttagggggcttgaatggatagtttgaaggtatttgaatgtccaccttgaatagcccaccttcgtaaggagttcctgggggtccaacgaaggtaccttttaggtgtgacagatcattctcgtcgatgacctctaaggttaccccactcaatggatccttcttgacgtcctccaattctctgctgattcgtttaatgctagtcattacaagtggtggatggttttctttaaccttttcttgttaattatgactgagtgaccaagcggttgtgtgatactttgttaaggggaaaaccaacactctgttgtgtaaaacgatgctggatggacgttcgagaacaatacatccgttaggatgctgtgaactttatataccaatatacataatgtggggttataacctataaataatcccgcctctcacttgtaaaaagctcttgactcgcacgctcatcttcaaagtttagcaatgaatgatctccaattttacgaggtttaatcaaaaccttcaagaggaacaggaacccgaacaggaaacttgcacccgccacgatcaggtagcatactcctaatccaaaatgacgtcctccaagaatattattggacgttataaccagagactttgatcctccaaaaatggatactgggtagtttagtccaatatcaatttgataagttccagactccattgcagttgtagtgtttttagctgcgagtttcatgaatgaaggtaaggctgccgtacgcatccaattctgaaagaattcattctctgttatgtcaaaaatgttgtcttctgtatagccgttcgggtacattttctcccagttgggaggaggtacgatttcatcccaattatagctagtttttttataggtcgtacgatcagttttccaagcaatatccttggtcgtcagctcataggtgacattctctgaacctcctgcaggatttagcagcactggcgaagatagggtgtcattgaaataagaattggctaccaatccacatgggtagacaatcttatccccagagtgagcaaaaggcttacaatctgaatcaatatcatcataaggcacagcctcacctttgagctgttccaagtcgtatgactccacgtatcttctgtgattctggaagaaattggtcagtttataataaaaatacaatggagaatgaatgtcgttgggaatgtcaaattcaatatggcaagttctgactgagtttcctaaagagtctgttgaagtgctggttctccatctaggattctgatagttgctgtaagaggatgtagacttgtcaaaatgaaagttcaccctatttctgggaatctcagcatattcgtctgaatcctctaattcatcgcatctgctgtaattaattaccagattctgtactctgtaggtcctaaatatcagggctatccctataggacacattaccaagaatacaacaaacagcagaggtaatattgtctttggcgagtagatcggctgccatgcctttagtctttgttgtctgaacgccgtgtttgggggctttctggatttggttctatcagagcccttcttaggtcctgaaatgtctaactcatcagagtccacagagttgcctcttcgacgccgaaaaaagttcatttgtcaataacgcagtcaatgtatgaaggttgttggtgtatgttgtagttgtgttcagtatcgcgggcggagatattaaaaagaaggaggcgcacatagtgcctctcaaaggttcccagcaaaaatccaaaagctatagtaaattttaattgtagtttttaaagtacaaacatctataatacacaccgttctacaacttcagcggttccggttgttcatcaatgggtttttggttcctcacatggtgttgcagtgtgccaaacaatctttccagcgtggcatcacctttgataaatggggaagagaatatctcatactcactgttgctgaccaactccaggaacgtcactaatataccccatgggatggggttatatgacattgctctctttgtcaatacacagctaatattgaactttatagcctctctttgatctccccatagagtagctgatcccacaaaatgcaacaaaatgcaactaaaccaatgcgtgtgcgagttgggatacctcaattggttggcaattgctgttaagattaaattctgtaactcaacatccccgtccttgatcaaagatgacaacagcatcacatgattggaggtagaatcaaaggaagaaccatcgcggaatgacttttgttcttcaactgctgcgattcccacaaagaatactacagcattgactagaccagcatcatacttacttttcccatttctgggctcagcaacgcttaggccagttgagatggttttcaataatgactgcgaaggaatacgcaggtagctttcgacgggcttcttgaggcctttggctgttaaatctgactcggggtgatagccaattggaggttcttgcttgatttcttctagcctgtcaacttttaatccttgttgaaatggattgggtacagttattcccttaggataggctgatgatataatattttttaattggacataagattcaggagttgaacttatcaattggtaatgatattgaaccaatagatcaggaaaatcgtgcgacaacagggcaatgattcgcagagttcctttgtaaacaacattcactacgtcactgatcttctcactatcgacataatgaagttgaaatgatagtaaacattgtaacagattcacaaatcgaccccatcccttattttcaggtacttccaagatcatcggcatgaacattctatgagaaatcaaagaaatccatgcaaaagtgaagcccggaaatgaacttggctgcattaccatcaagttctgagctaaaatgagatagagctccgaattaaatgtcttcagcgattcatcgtcaccatcttcgaattcgtgtctagcgcttagccagtacgaaaacagcgatgagaaaattctgaaataaggtctttcattgaaactagtactgttattgttatggtcgcttgcaaaggcaagaactataacagctaacatagaattgaaaaaggtctttctctcaactccagtagaatcctcttgcataagcaaaagtttaaccaacaacaaagcgagtgcgtccgcgggagcatacgtctcaatgtgcaacttcttacttgggtctgcttctttggaaaaagcagcaacagacatttcggtggcagtcgtgatcaagagagatagattttcactgttgttcacaataccgtcatcaactaattgccatatgaagtcttctaatactctgttcactctcgaatattgaaccaacttaacccattcagcaaatacatagctcatgtattgttttttagatattgtggaggttccgaacatcttgaaaatctgaattgaattgcttttgacgattgcttttagccttgagatagacatgtaggcctttctgccgatctctgatggttcatgagcaaggacttgaagggcctctatactgtttataaggtctgcacgtaatgcaattgggtcctcactgaggatggagtcatgaatcaaatagattgtaaagagaacggccttaacatttttcttttctatttgaattgccaacgaccgatcaagttcagctaacggaaccaatcccaacagaatcaaatctctcatgacattcttgttatactttctttcatcctcagcatggactaaccaccaactaatatccttggctgtaaaaggcgataactcacacaacttgtccaacaaaaacaccaacgtgttttgagtcaatgatgagttggtccggacaaacagcatgttcatgacgtactgagatatcttgagaatgagtgaatctgttacagtagctccaatacaagtctgcaatatttctcctagtactgttaccacaacactatcggtgttgacttctgaaataagcttttcaggagcatcacgggtcaggttaatcacagagtcaactaattgttgcaaaaacataaaggtttgctccagtgaaacggcgcctccttggcctggtaatgccgggggcatttgctgtttcatttgctcagcaactccaggtggaaccaaaggctgttgggctccttgacgtaaggaaggatttagttggctgtttatgttttgcaaatgttcaggctgttgcataggagaaacaattctgttcttaccaaagttttcgtatatcatgaactgttttggaatgacaccatcggatttcagtcccaaaggtacaggcagaagcattgggtatcttgacctcatagtaggatcaatgaattgttgattaggttttaactccctatgctggcgacgaatagccagctgaggtgccattaattcgtcaatgtcctgaattgcacgttccacagcagctttctgaataatcgttgaggccaaatcgatattatccgtaattgcttgaggcagttcttcaaaaagtgtgctatcaatattgggcatggtgttggcgatctggagcgcgttcatttggatgctctcccttagtggatcacgacaagaagccaaacttaatgactccgtcagatagctgacctggttaatataggccgttcggaatttagcttcatccgattctagagcaaaatccttcgaaaccagtgccttagtggtaaccagagcaattaagtttgtcctgtcaactacaaggggtaaaatctcctttacagctcgggctaaagctgcctgaaacaaatactttagagttggaattgtaacaaaagacgtcgttcccaacaaattggagaacactttcaattggttactctcatctgctggggtagctgtactaactccaggattggcttgaggatcaaatggtatttggggctgttgaacttgttgagcttgcaaagcagcctgttgttgcaaaaagaattgctgttgttgttgctgttgctgttgttgctgttgctgatgttgttgttgttgttgctgctgctgctgctgctgttgttgttgcttcatttgattaacattagatagtgtcaattctttcatcatgttcgtagctaccgcaaactggtcaatatcggccggttgatgtgttctaattatgttggctgcttcaatatctcccaacttcgtgttcaatgaattatacagtacttcaatctcaaacttcaattttaatggcaaattaccaacgtcgtaaagctcttttagcagtttcagatttcccactgtccacggattgggaggtaagaaaacctttgaattcttggcctgatctagaatcttacaaactaatggtaaaacaacttctaacttgttcttatcgtaagcttccaggaccaacattttcagagctaagttcctgtgcttgagtggtctgtttctggtaagggtgatcagtcctaaccaagaacctaaattcttgagatgagttctctcaggaccactaatttcatcattgacatcataacacttattcaaaatgagaataatctctttgaatgtgaggttaagaatgtatgcatccaatagcagattatccaatcgagaaatcaaagaacaataaagtgaatggtaattaggttctgttttcactctttgggtgaccaaatagttagaaaaccattcaaaatattgaggctccaaaaccttattcatttcttctactttagcagaaagattttcttcagttatattgttcacgaggaacaggacatgatcagaaacgttttcatctggtgtctcttggtctctacgctggagttctacagccaaattaagagacttgaactttgacactaccaacgaatcatttgacggctgctttccctgtgaaggttgtctttcgccagacccaattccctgggaagggattgagggaggagctctaaaagttccattcatgacttgttgaagaatctcataaatttgtggttgttgcttcaaagaagggacctccgagagaagtgcgcaatatgacttgtaatcgcccagcttttccctaaaggtgtataaggcctgaacagcaaacttaaacatgttgtcttctggtggctggcgacaactctccaaaatgtatcgcaaagcgattgttaaagtagtaccttcaatcaactgaaaatatatcgttgaaccaaaaagtaccgaagtggttgccaacgcatcgattggatactctggaaagaatctatattcgtcgagtaaagagtggatcatgcaagcaaaaatgtcttgttcatgaggattatccgaatccttgaatgccttcaatgaattaataacggatttaatctccaactgtttcaggtacattttctggtaataactcttcatttcttgctcgactgaaggtgggaatgagtgtgaatttccattcgccagaatggcttcgtcatgaccacggccaaagttgatcagtctgggataagcttgaataacagaaacttggacattcttgaatttgtcaaccaaatctccagacagcttttgtccttcgattgccttgagtaaagtgtagacaacaggaattgacaacgacctatgagacttgatttgagcattggattcattgttagaactttggtattcaaagctggactgctcttccaaaaaatcaaccagctgactctggacttgctttggattgttacttaacaaattctgaacaaatttttctagaccattccaaccaagattactggcttcaatagcaacacttaaacaatcattaaactttgataatttgttaagtacggaagaaagtacaccgtcacggagagcataagttgccacagtgatcgcaccattaggtctcaatgaaacgtagtttgcaagtaacgacgaaagttcatcctcgctaatttctttgaactcagtcagcaaaattatcaaatatggtgaattgatatcaagtaactgaacgataaagtgatgacaaagattcaaatatgccaaggtagttcctggatcggcattattgtccttattttctttccacaagtgtagtgccgccaaacctaagtattctggggcagtcttgtaagaatcctcaatgatctcattgatttgattctcatctgcagttgctggtctagatttcagttcgaccaaaagtgatacttccagctcagcaatgtatttgaaccatataatagttcttcgtgagtttggttcattggcgagcactggttgtaatgggcaggacaataaatctatagcaccatgttgtgggttcaaggaatacaaggatacaagaaggttcttttgaaacaaaaatggatgatctttgagcttatgatgagcaacgtatcttaaaaatttgtcaatattctcgggttctaatgaagctaagaattgtgaaatggaggcaacggttacctgagaaattgatgttgcgtcagaaaagtagtcatctgtttcaaagatgagctcaataatttgatcccacgtagactgttcaatatttaaacctttcagcaaacttctaaattgtgaacctctggccgtagcctctggtagggtggaaggagttaatgcagttgtttttgtggatgtggaagatgaaatgtgttgggatcctggaaccaagatttcggcaaataacaatgcaagcacatttttctgttcattactatgctgcgaaatcaagtcagccaagaactgagatggggttatgctggaaggtgtttgtgataagagggactgtttaaatgacattttatctgggtctggtagaagtaattttgtaagatcgcaaggatttaaagatttcaaacttgaactagttgctgatttgaaaaaatgaccctttgataattttagactcaaatatttgatgcttgaaggagatgttttgtctggccaagcaatctgtaccgtgttctgtagaacggaaggaaaagaatgaacgtaaaactgtgaaatatctttagctaatttagattgtaagtcctccgataaatcttcaaaacgtgaatcgatgaatacagtaatgaacaggctttcaatgaaagaaaagttgcaaactgaaaaaagctgtgctaaaggaagctcaaagttaggagttcgatataattcaaggacagcttcaacaaagtagtcaagtaagtatgcttcagagagacagatataactgacaaaatagcggcaaaggcgagatcgtacgtttaagctctcgggatcaagtttatgtctctgtaaaaaaagactgaaaagaaggtccaaaaagtattccctgaaagtagaagagcgtgcctttttcaacaaagttaaaatttgccgggcagtaaaatcgatttcggagtcagtgacttcggtttcttttaacccgtctagcttacttgtaagaacactgactttgcctaagatggctctgagtaagctatctggtaacaattgatgcacctctgttaagtcctgggtgcttgtgtcgttcttaatggcgtgcaatggagcagcctccgggcccttgtgtattggattggagattggaaacgcggaaagaatgtgaaacttagacgagagactcttgagtataatccttttccaaagttcttataggaaaggaatgtacaaaatgttctctcaaacaaatgattcactgggattttaatcaattggtctgctaactatcgcaggaaggccttatttcttgaaggttataatatgagaagggaaagttaatcgtcgagatggcaaaaaaagagatagcaggccgggtaatccaagagaaggatcgttttagagggtaaagttagtagtgccttgatcagactgaagctaggagcattaggagatacgagggtacatttgagtcatgttgatcctaagttccttcaattgaaggaagctttgagacttgactgtgtgaactaactatcaaacttgtacaatctcatctatcccttcagtttagtactatccgaaaagtcttgatctctacttgcttatataagcttttttgattagttctcgcgagttttttgatcccagcacatagattaggattcttcaacggtcaagagaacgtatactcctactattctcctccccttgaccccggaccttttgtttgttagatgaaagggatcaagttcatttttatggccctagccgcagctgtggcccaaggtatctctgacaattcccagtggtctaatgagcatgtggtgacctccttgtcccttcctgatctggatttgaaaacttccatgaagagcctgaaagattggaagctgaatggagatgtcaagctggatgaagggagaattattcttactcccaaaccagaaatagtctctcttaatgacaaaaagaagcagatcaagggatctatttggactgaatatgggtttgggttgaaccagtttacaattgaagtaaccatgagatcattgggttcaattgggagaacttcttctgggcttagtttatggcttgtagatgaccaagcgggtaccatttcacaagatccaggaaataattttgggggcccggaaaaatacaaaggtttacaagttttgatggactctaatgacgctaaattgaattctgtcactaggagttacttgatggatggtgactttgatatatcaaaggcattttccgtatgtaattttccttatcagaacagcaatgttccggtgattttgaggttaagttacaagaaagggaatttcaagttgactatcgataacaagttatgttttcagacagacaagataagcatacctttgggccgattttggacttttggtatatcagccgtaactcgtaacgatcttaaagttcatgaacaatttgaaatactcaagttaaagacattcaacgacgtggttgacacagacgatgaggtagacctccttttggaccagccttatgcgactaccacaatcatggaacaagcttctaaagaaactgcagcccctgaatcaaagccaatagtttccgaatttggtaactcgcaagcttttagagaaaaagagttggaactgaaaaaccaactagcgcaacagaaatctgcagaagcactcccttacatcattgctaaactggacactctggagtcattggtagatgagaccaatcttcttataacatcatcgaacgaacaaccccatggagatattctcttacagcagatcaatcgtcaatttcatgaagttttcaagcatatcagatatgttaacgacaaggttgaattactgtccagatctccagactcatcatcatcatcgtcgtcagtgacttcaagtaacgtagatggcttaaaacgggacattcttgctcttacagaaacagttaggggactaagtgaagaacagaaaatggtgatgcaggcactgctacgtatcaacgatcttgtaaaaacaccattgaatcacgcaaatgtggtaactcttgatgaggttgcctccaaaatgaaaatgtatcttgctccgctactcctgatatttatcgtcataattgttatgaattacagactaggaaaacagattcgtcatgctaaaatactatgattagccactagacttttcagacaagggttcccatagatagtacaatgcttgatcacactccctttttgattccggtattttgtaggtagtaactttctacctgcttgattatgataggaacgcaggaacatgccaagaggatcaaggagggacacagatacttggtgttcgctgcatggaacgttgtgcattatatatgtctgttttcacgataaaagaatagactggtatttttattaatgtttttatagttcatgcatattctcttgtctttctattacccaactcagtactatcaaaaacgaaatttcgtgatttgatattctcagaggtagaacgagctgaagcgagcagtgttctgaatacaagatagccctagatgaacggaccgattccatgatcctgagctagggcgagtcagctaattgttaatttagcgtagttgtgaattcagcaacgtatttctcttcagcttttcctggtatggctggccagttatcctgagcgtatagccttgttaactctaaacttatcacacacaattgcttgatgcatagaaacatagagcgcgcacctagcataaggtggagagagtgaccgttttaaagccacatccatcttctatacgcatggaattatttccatttagatagtgcgcgtatccagcataaggtggagtcaggtaacggattttcaagtacatcttgacccactttcttaagacccacttagggttgccctaattacagaatcaaaattctcggcgcatctacattgttactaataagagaattcgttctttatagcaaaagctcctactgaaaagactactaaaaagtactatcacatgaggatccaaattataatccaaaagatggatatcgattgatgggtgactcacgatacttttttgaattcaatctaacgaatcataccgacagtctaatcaaacttgctgtattcaggaacccaatactgtctgaccactggggctttggcaccaagagtagtaatcttttcgacctcagaaggctccaactggaagtcgtcaatcttcaaaaattccttgactcgttcggttttggtgcttgtggtaattggaattattcccttctgtagaacccactttagcagaacttgggtatcagacttaccgtacttcttgcccaattcataaacgtaatctaaaaattccttgacttccttaattgacttatcgcccttgtacaatggagccaaaggagagtaagcttcaatgaggatgccattcttctgagaaaactccacaactccaggagtctggtcttgcaagaaggcattgtattcgatctgattcacctgaggcttgaccttggcaactttcaggatcttctccaggtcagccactgtgaagttagagactccgatatttttggccaatccaagactttgtgcttcttctaggtaaccccaggcttcttctaaggtaaaaccgtgggtttcctttgttatgtaaggagaatgtagcaagtacaagtcaacatattccagttcttccaacctcaaaatctccttcagagccgctagtgggttggcagctttggatttacttttgtgacttgaatctccagcatagtatttttcagtaatccacaacttctctcttggaatgttggccttcttaatggcatccctggtttccaatgctgtaccataacattcggcaccgtcgagatgggtgattccaacttgcaaagcggacaccaaagcgtcaaccaaagtctggtcgatttctgattctctaccgtatttgtaccatgtggtaccggttccgaagccaatttgaggaattgccaatgccattgttagtggatgtgtaattgcgtgatgttagatttcaaatttcaacaggacaagctcgattagcttgctatttatatgcggagggggagaccgaaattattgctccagggttgacgatctgactgcttaatcgctcatgctaggggttgcttagtaattgaggttgcaaggatagcaagatgataccataagcggtaagtattgacactgtgagttgacgcaattgctacaaatacatcaaagacatgacaccattcgtagatatgactaaaaacattggatgtagcacaattcatccgacgtagccttcggatgaataaatgaacccgaagaaaaattaagtggacgagttgggaatcgaacccaagacctctcccatgctaagggagcgcgctaccaactacgccacacgcccaatctttaagcatttgctgctcatgtcacatatatgatggaattttagctcacgatctttccacgcctatattcaaaaagattcaagagggaaactatgagctgccgttattcttgttagattattaaaagtggtaaaatagtgtttcgttcttcattgctaaaagtagtatggataataaattggtctagtattacagaagtactatttaatctgttctttttttcaattttaactctctttcggcgagtccgtttgggtctaaatttagcaagtaactccgtatccaactttgtacaattgtataattcttttagcatttcttcacaccattcaactggagacatcactatatctgcaaagtttctctctaagtggtcacgttttgatattattgctccttcatatagaaaaaagtctctgtcttgatttagttcttccataaacgcgctcttcttatcttctatgttcaagtagttcacatactgatgtattatttttttttcctccgattggttgtacactcttagtctcctatctttttgatatgactcaggtggatttgacaattccagatttacattttttattgtccatcttcacacattttaacatatttgcaaatgtttccaatttctcctatactcttcattttgtagaagttttcaaatctagatttcaagacaacgtcattcttacttcttacgacaaaataatactcagaagtattcccatttaccttcaaatttatcaggcttgctctgatatcatcttcattatcaaacttcacgaagcctattttatagtaacactcttctagtccttctttgtcagggatttccaaccctatcaaaacactatatttgtcatgggtatgcagatgatctagtgctcactgtcatctgctctacctccatacaccaattttagctcacacacgactggaaactcgaaaatttatcaaaagttttgttcttaaaccatctaatcactattatcgacaatggcaacagcagtagctcaaaactgggcagatgaattgccacaaacacaagtcacagacaacggagatggtaccaagacagtagtctcgttcacacgcaaccaacaagggaagaaagtcaagataactaagaggatcagagaaaccatagtcaaagaagaagtggtcccagccgtggcccaaagaagaaagtggtcacgatttggtgaggaaaaggataacacagctgtaggtccagacacaagaacaaccatgttagacgatcctattgatgtccaatttggtgaagaagcacgtaagagaaaggaagaagaagtcaagaagagaaagcaaaccgaggtaacaaaatcattggtggtgtgtagattgtgtcaaggagaccatttcactaccaagtgtccatttattggtaccttaggtgtcgatccagagtccaaccctaacatgtctggaaacaatggtgaagccgagggttccactgctgatgtctctggagattctgtcggctctggtctcggaggctctggaagctcctacgtgcctccacacctcagaggaagagggggtgctatgccacgtcccggaccaggtgaaagaattcacgatgactcaaccacaattagaattacacaacttaatgaagttgtggatgaacaaagattacgtatggaactttgtgctccatttggtaacattaccaaggctactgttgtcagaaacagagaaactggtaggtcaaaaggagttgcatttgttgcctttgagactgagcaagaagctcagttggcaattgaccgtttgaacaacagaggttatttgtctttgattttgaaggtggattggtccaagccaaagcctaaggtgtaggtttagttgtatatcaaagatttaattgaatgaactgcgacagaaggtaaagattactaagcattattgctcatagagttgatgaatttcggtgtcctttgactcttagagatttgaagtcattaggtagtaaaggagtaacgtatactgatctgatgtcccagcagtgtagaaccttttaattgactatttgtaatcagaatccattcgttatggtccacttaaactagaaacacgtggaaattgcgcctgtggtttagtggtaaaatctaacattcccattgttaggccccgggttcgattcccggcaggcgcataatttccttacttttttgatattaacttattgattattctatgtattcctcttcaagtaagctatctatcacctcttgacgtttagcttctatgtcagtttctttttcatcgtctacttccatcataccgttcttttctggaactattatcacgttctttttaaccaatgtccttactttttcttctattcttgcacaaaccgtttcaatgttttcaatctcagctttgtcctgttgtatcttgctttccatttctagtatcaaaatctcacgggactggtgcaatcgatagctgttcaacagataatgtaaatttatcaaaatgatccgtatatgctctattttctgattagcataactgggattcttagcaactatgcccagtagctctaagaagtttagcagcaaagatttggtcatttttttcatttctgttagtctttcatgggagaatacttcgtcctggtcattctcctcagatatgaaatttggatacaattgttgaattccagaagccttgagatctatgaatttatctttaaagctccagacacttccaaatgatcgatatgactccccttctggctttgtagggggaatgaggaattgcaactccgttcctttcacctgctgatgtatttcttcatcactctttgtttctctcaactctttaagtttttcaacgtttttactggtgaaaaatttcaaatacggaggcggaggagggtataacgcactaatgagcccatgttgctcgtcttccatgagtccagtgaacgtccaattactaaactgttgaggaagaaacagatgtatctggtcacctttcaagtcgcgccgtactatctcgtctccgcgtagacctccacccaggagcttccttccaataggacgtttcaatcgattgggatgcacctaaactgataaacagaactcaattcccaacagaatcgcaaccaaagattagcaaatacggatagcattcgatctgctctctacggttgcccaaatcttcctttagagacggagcgtgctggttatcaatctcctcccccctaactgttccgctaaataaatcgagaaacaatctgaatctgactacttctaccaaacaaggatatcatgtcgacagaaagcgttgatgaaatggaggttgatgtaccaggtaagcattcttttaaaggttctgtttgcaccagctactaacatctcagatggacaggagaagaaacgatttgaagtcaaaaagtggacagcagtggcgttctggtcctggagtaagtaaactctctaccaagcatcttagaagaagtactaataatcacagatatggtcgtggaaacttgtgccatttgcagaaaccatctgatggagccgtgtattgattgccagccaaacagtacctcccaaagcaatatcgaatgtgccacagcttggggaacttgtaatgtaagtgatctttcgaaagttttcaggagtttgattatactaaccccacgcagcatgccttccacatgcattgtatcacaagatggcttaagactagaaatgtttgtcctctagataacggagaatgggttctacaaaaatatggaaactaggattaaaacgaaattaatatatttacatcttacacttaaccctttttcagtcccagtactttttggaccgaggaaatgttcccaaaacaaatttctcttgaacataatcattcagtttctccagagcattaactgtgttttcatcttgatcatcccagaactctataaagaaaatgtaatgccaggatttcatttttgaaggccgagaggcaatagtttgcaagttgattccatgttccttgaaacaggctagagcatcacacaatgcaccatggttatcatcttttttgagcataaatgccatcaatgtcaatgtttttgatgatttgtccgtagtgagagggagactgtcatatcccaggatcaagaacctcgtagtgttctcgtcaaaatcttcgatattcgcttggaatactggtacgttgtgtaactctgcagctatatcactcgctatcgcagcgacatattcatcccccttttcaaccgtttctttcactatctggacggcccgagaagttgagctacagtcaattttctccaaactctttgggaacactttatcatttgcctcaaaaaaacggttgcattgactccaaacctgtggatgcgaataaatcttggtaatcttgtctaaacttggggcatttgtaattaaattatgatgaatggagacaaattgttcccccacaacacggaaatctggtgtattaccttccttattcataaaccaatctttgagataatcataggagaataccacctgtccattggaagagttctcaaagggaatcacagcatatgagacggttttgtcactaagtgcattgatacagctacggatagtggtctggggttcatatgtgaaattttcaccatttgcaaactcttgcagggcagcctagatagttagcaaccttattaaaactagaaattaaacccattaacttaccttatgggaatacgttccctggggccccaaatatgctatattagtcatggttaggttatcctatatgggggaacgttagcacgacatgatgcaaaacttcgcgggatttggaagggtagagcgtacggtggaaaaccgttaaaaacaaggagagcgtcctctgaaacgctagggagaatcttcctcaaggagaaagatatagtttatagtatgtacatgtaattaaatggcctcttatgaggaagtttctccgtggatatcagagaataatacttggtaagctttttcgtcataattatctgtctcgccgattaatggcgttagactagccactccactcttcaaaagtattctttcaatcatgaatcgctcaaccagggtggtttttgattttgaaagaatcaacgtcacacgaggggattgggattttcctgcaattaaaactaaagttttggcgtccttcaatgcatgtaagcccaaacagatgacagatgctaggccctccaagttcaaaccgggaagttgagaaggcgtggatacgagaaactgactctgttcattttcatcgttgaaaaaattagctgtggatgagcttaactgtttagaagaatacccaagttttgttaactgttccattatagttcggatcgtaatggaatctggacatatcagaagagactttttcttcctcagttttgcagatacagttggcaaagcatctaatatttcatctgagatgagttgtgaaagggttttatctttttgtagctgtgtggtaaggtgtttctttgcattctcatcgaattcttttccaataggtgacctaatctttgacaaaacttccattccagtagataacggaggaagtttaaagtccaagacctttctgctatcaccaatgacaatcgataatctagcagattggttgatccgggccctggccaagacatcgcctttagcgagtagcccaatgggcaatagggttctggaaacgttccatttgttttcttcaatcatgttcagcagtttattgctaatatctagtgtttcaatgaatccaaactgcaatggctggatattttttgttgagctgatagtctcttttaacttcatgatataattgatcaagatttgcgcaggtctttcatgaacgacttttttattatcattcaaaagctggatatcagcatcatcgacaccaagaaatttgagctcgtgcaacctcatgtacaaagggtctgaattatttttactgatcagatctagcattctttgaggtgtggccaccattacctgcggagttttcaaatccaactgtttctcctgatttagctcatcctcctctgaacttctatacaagaatgcaacgtcttgaacttccaatgagtgacataatttttgtaattgtaataatgcaagagtagttggtgctagcaacagtgatcgtcctcgtattgaaagagcatacaatagaaggcaagtgctactccccgacctttgcgatgcaaccgcaagcactgatatacctgagcataaaatagacaaaatccgtctctggttatctgtaggccggctgatatctaatttttcatgcaattgtcgatccaatcttgaagatattccaaagtctttaaacgagccctcaaatcttgggtcgaatttgatcttcagcctattgtacttatcatgcggacttttcagggaactcttcttgttcttctctaaactttctataacatccctttcaacctgaactctgaggtcattgtatctattcctacttatggatcggttagatttagggttcctcttcaagttctgtttctttaccgaggtgataacgttcgattctgaaacagcatctcgctggaatgactgatgtatccagcgagagcacacacccaggccatttatcgaagttctccttatggagctgttgagaaacatgcgatgggtgaatcagtgggtctttcaagccagaaaaaaatattctcctgcgagcgaacaagataaccttcgaggccagttccccaaattttccgtctaatccgacttcatctcatcgcaaaagttggaaaaataattctctttcccaatgattaccccaggatgttgcccagaattttagcaagtcaagtcctaagacaatcttcaagaacactattacggtcttctagatcgccactgctgcggaaggcttcttctcagtttttcaacggttttgccagatggaattctagccaacctctcaaagtcgataaaccgcaactaatgattgccttcacttgcaagaaatgtgacacaaggtccagtcatacgttctctaaacaagcatataccaacggaaccgtgttaatccaatgtcctggatgcaaaaacagacatttgatcgctgaccatctcaagatcttcagtgacgaacgtgtcaatatccaggatttgttagctgcccaaaatgagtcagtatcgtcttccgtagacgatcttgtttttgaggacattccagaaaagctgaagaaggtaattgggcaccatgcaaaggacgctccagaggaatacaagcagaaaagacaggtagaaggaggagcattgccagatggaagtgacaccgataaataagcaaagaactagttattatatataaatggaactaaataaagtaaaagatattatgaagaaacatccgtcaatattatttggattctatcactggctcaaccagatgtttgttctcctgtttgttctcccgtttgatgtaatcacgatatactccgcaggctactttcttcagcgcatgtcttccatcccatagtgggtagatacacaccaacacgatagccaggtaagtactaccaattgaggcacctgcccatccttcgaagaatgacctactccagatccagtttctgtaaagtggcattggccacagaacttgagtgactaaaacgttgatcacaaggtatattcttgcaaccttaagccagaacttaatcttgaccagttccttttctctgtcagtaggactttcaatggagccaatctcagtggtgtactctggaacaactcccttaatttccctatcttcatcagagtgtgaaaggttgtctttctcaaactcactctcactgctatcttcctcaccttcaaccaaagtggcatcttgaagacgggcccagtcaaacttgtatggcttgtatagcaaactgacaagcaccgtgacaataccaggtacgaatatggttactaaaccaccatagagacatggcagttgttgaccagtcgaagcaacactcaagtctccgtacattgtcttggcaacagataaccatgtggcaataccggtactaataccagcaataggagcaacaaatgctgcaacagtggtctgtctagaccacagaatggacagcagtagaggaatgacaccaccacaaatgatcatagagtagaagtaacccatccaagtcaaacttacaccaacgtagtgcaacatgacagagaatccagcggagaacaaaccaaagaagacaactccgaaatgggtaactttgatcatttgcttgttttgagcttcaggattaatgtaagttctgtaaacgtcaaaactcagaatggaactcacagacaccatttgagaagagactgtggatgtgacagccatataaagagctaaaagcagggcaccacaagcaccatttcctagtaaagccttcaaagtgtagggcaacaggaaagcgttagcaatttcgtcagcattcatagggttaggataagtggggaaactaggtttagtcgacatgtaagctccaatcaaacccataactgtacccaaaggccaagaacaggcgtaaatagtgatggagccaatgatgtaagcgggaaccatggtttcagttttagcagcaaaggctttagcccagaaggcactgtccataacagctaaaccgaagtcaccgatagaatgaataagaccgaaaatgatggcaccttgggacttgaaggtgagcaaggaaccttgatagttaccctcgatgtagtactcgttgtcagcttgccattgtttcaccaaatcataaagatttcccagactcccgatttcgttgtgggcgacggatgcagttgtgaaataggcaaagatgatcaaggcgataaaggtgtgaacatactcagtgatgaacgttcccttaagaccaccggagaaggtgtaacacagcacaccgaatggaatcaacatggtagaagcgacaatgtgcataccagtcaaagcagtgatggcaccagaagcacccaaaatcatagaagagcatgatagcaaattattcaccaaacacaagaagatgtatagtatgtgagtggcctttccatatctcaggttgacaatctccaaacatgtgtgagcattaggaatcttcctcttacattcaataccagccaacatcaggaacacaacctgcacagaggaagtagaagcgtaatggtaggctgctgccacaccataactaaacaccatttggacagaccaaatagacacagtagcccacatccaggaggacatgatagcagacgaagccaacccgacaccgaccgatctgttacaaacagtgaacatctcggtgttacccgtgttctcattcaggtactttttcatcagcctggtactgattagcaccataatggcaaacagagcaccaacacctaccaggacaccataccctgaagcttgattaagtaattccttgacagccatcggagttgagatcaagtgatttattgaataatttcaaaaaccgagtaccgcttctaccgtttatatataccaagaagccaccctatatttgggatgccgaaacatgtatgcataattgtgttgtggctgaacaattaaacacttaactagagctacccttagtcaccttaatatttcagtggctcctgtagtaatgtcacgtgcatctagcacattttgaggacggagccaagttttttcatacaatttcgtacaatagttttattaatctgcaaaattatggcatttggggtaatttccattagagtcttgttagctcacttggaaaagcgtggcacatttggcagctgataacatgtcgccccagtttatgtgtgggctaattatacttcagaattcgaatttccatacaccgattgctatgacttgcgtccgatcgcgatatcggctatggcttttgaaaattcatctattgaaatgccgcgacttgacctttttagcgacctcgcagcagctaattaatacttaactcctagcctctttttctcttcaggggaattaagcccattcgaggggagggggggaatttttcaaaatttgtgacaccctggtttttcgttcgtacccggggggttgatacactggtagatcatcaacatccatacatcactttgaggtcatgacatgaaaatatctctaagcgtatatcacttatcatcaacattcacttaacgcttcccctgagccccatcttgataaagctcagttgcccgtttgagatatcagtatagcttaggttatactctgcatcgtttttattgcttcttcaaggtttattcgtttcctctgctgttactcgcctcaccatataaagttgatatcttcaatgattagtgtacaatattgcgatgtcaaacaacagtgaaggtaggcccaaactaccctttttagaaatatcatatgattcattgcgaaatctgaaagattcagatgtcgacttccaaaacctgctccgtgtgtggacaacgttgacgaaatcctcagactccatcagaaatggcaaacgactggaaaatattagttggagagttgtgaatcgcaaactgcttcttaatcctttgaatcgtgaggactcacttgatcccatggactttcaagccctcagccgaatctctctctgccgtggttcttcacagcccttcttggccgagtataagagaaagaataataagaagggcaaaagcgagcaagctaggccaacttctgatctgaaccacgattcgatcatgtcgagtctggagaagaagaagttgcaaaacggtatcgatcagtccattctagagatacctaaacagcctagcctgtttgctaaacctctacctcggccagaaccacccagcctatttcagaagaaagaggctaaatcatcggagaacaaaaggcacatgttttatttacattcgccgtcacctgttgatgaaaaccccatggaaaaatgtccttcacagtctctcttctcacagacacaacaaccgttacctgacaagcctgcaaactccacttcgttgtttggcaactccaagaataaaacaacctcgttattcggaaacgaggatcgcaaggagattgtgtttaccagtgatgaatcgctgtccgatgattctcaatggtcaagtgtttctgactcagaggagagtgaggaagaagagccccggttggacttccacaagaaagatttccccgtcgagaccaaaccagccatgagaaggtctctgttatcaggtttgtttcttcatgaactcccgcaccgaaattctgaaccaaacatacatggtcaactatctggcacaaaaatgtaccagaatcccacaaatgcatcatccaagacatccatagcgactgaaagtaccaccatagtaaatccaaaaataaaaccacctctactgaggacaaagactgtgcccaatgttaatcatagtgctgaaagagaagtcttagaagtgtcatcatctcagcttgctaaatcaactttgtcatgtaccaatatcactgctatggcatctgtgtctactgcaaaggatgccagaccgcttttgaaacgccaatcatcccatgacgtaacaaagaatgacgaagtcagctctttatcaaagttggtgtctctgtcaaagctgaaccttacttcatattttgctggaaagaacaacaaatctggccatcaccacaagtctgaagtgtctacagctaattctaacagggttcctgcgactgctaggacattactacctacggccctttcaacgcacatgttcctaccgacaatggccaattctcgcccttctacgttggctcaggttgttgaggctaaagaagatgattcttcggtagatggaagtgtccgaatgtccctgaatgcgtctcgtcgtaattcagaacaaatagaagttggcataccgcgcccttccacacccgctggttccaacgttgacgtcgttcgaaattcttccattgaaattcccggatcctccgactccaagagttctaattatcgcagagacaagacccctgatagggacggtctaggtggtaaaggctcccagggagctactgcattatcacctcgttccaccaagaaacgtatgttagcatctgaactatctcagtcgttacgagaacagattctgtatgaattggaaactgctcctgagaaccatgcgcaaacagacaatccatatctggcccacaaaatccgccatggccaagaattcctggatgatgacaagctcttagacgagctgatcgataaaaacgatcctggccaaatgagagaacagcgtctcaagaacatgagttctaccaagttagaggtagtccccaaaaccgttctaagtgatgaggacgacgacaatatgagttatttcgccaagggatggtgaagattttaacaaaattgtctagtggcccttgactcttctctcataatttgtgccctcaagaatctgctcttccataaccgatcattatcgtaagtaaactttcacaaaatgatagataacaggctgtaaatgattatataatcaacaataactgctgcgacgcgcacttcactaaatctacagtacgattcttcactccgatagtacgtgaaatgacgggcagcacggagggatcaattactgcaccagagtttctggagcagcagagccttttagaaaaggaagctctggaattgatgccattcgaccctcaaagatgcacttttaccgatggagctctacgacaacaattgtacgcctgtttgacgtgtttgaaaaaccaacccaaaagtgagggagaaaaaccagtgttttcaggtgtgtgttattcctgctcaattcaatgccatagtactcatgaattggttgagcttttcaccaagagacattttacttgtgactgtggcactacgagaatgctatataatggcggctgtcgactgagaaacgtcgatccaaagtcgccagcggatgacataccctcttcatctaatagatacagcaacaattttgagggaactttctgttcatgcgagcagccttataaccccttagaagaaacaggaaatatgtttcagtgtttttttggagaggtttgtaacgaagattggttccatgaagaatgcctgatgggaattcccagaggttctgttgaaaggaaagcaaagcatactttgactcggaatggaaaaaacattttggagactcttccagaaattgaagttgatgaagacgcagctactaagactgaagaaaatgattccggtgaagaggatgcagcaccacttccagggtttccttctgccaatgattttgactgtctcatatgctggaaatgtgttgacaagttcaaagccttagatttgattccacggtctgtgaggttgccagatatatttcacgtagagagcaaatcactagatgaccgagcaacacaattgaaaaactacaaagaaacacagtcgaattccaaacgcctaaagaccacaacttctaaagatttcaagttttccatttttctaaaagatggattccagtcggccttaaaatcaatcatatccaccaacgaaaaacattacgaccctctaatatccctattaagacagtttcccttcctatatgaagaggacccagtctacgaaccccctgaagagagtttacattctgaaacagaatcttcatcaatgtttgatctcgggactaaggctctggaaagcttgcctcgagaacaagcaatcgaaggccttcaagcctatgaaaaagtaaaacaaaagctttcacagttcctacgtccctttgcccaagaagggcgcatagttaccaaagaggagattaagcgattctttgaagatactgaataaatcattaatacattctaaatgcaccattatatacaggaactactaagcagacttttccttctccgcttccttctccttgattttgtcaaactcggctttccaaacattgctggcatcagcgactgaaattccgggcaataccttctcaaaaacctcatggtaccattcaacaggcactggagtcaagccttccttgatgttctcaggaagttctttccagtcagagagattgtctttagggaaaatgatggtgtcgacacccgaacgtttagcggcaatagatttttctttcaatcctccaatacgaagaactcttccagtcaaagtcaattcacccgtcatagcgatggtaggagaaagcgacttatctaaagcaagagataacagagaagatgtcatagtcacacctgcagaaggaccatcctttggcgtagcaccttcggggcaatggagatggattttagccctttcaaagaacttgttctctggataatttttagtcataaacattcttgcaaaagaataggcaattctggaagactctttcataacatctcctaattgtcctgtgatttctaatcttggcgttgagtcgtgactcaacggctgttccaagacactttcgatgtagagagaagatcctcccattgaagtccaggcaaggcccattacaacaccaggtggagttgtctcatagagacggtcagaagtataaactggaggcccaacataatcctttaagttgtcaggagtgatttcgatcttgaaagattcaggaacctttatctggggaagagattctttcacctccttcgcagtcttgacatcaggcttggactcgtcatttgaactctgactttgagaagattgttccgtttcatcagcgatcttaggattagctaaagaagcagtctcttcctcgggctctacctcagttctttcagtttcttcttcaccaagctctctcactacattcaatgcggcttttctataaattttctcaatttgctttttcaaatttctgacaccactctcacgacagtaattcttaatcaaactttgaataacttcctcggtaaggtcaacgtttacatcctggagaccggcactttgtttggcttcaggagccaagtacctttcagcaattttaatcttctcatcagcaatgtaaccagaaatttcaataacttccattctatccaacagagggcctggaatagtgttcaactgattggcagtgcaaacaaataaaacttttgacaaatcaataggaacgtccatgtagttatctaaaaatgagttattctgctcaggatccaagagttccaaaagagcagatgagggatctcctccattaacactatgagtatgggagattttgtctatttcatcaattaagataagaggattttcagtctcagttttctttaaagcctgaacaacacgaccaggaatagcaccaacatacgtccttctgtgaccctttatctctgagacatcacttagaccaccaactgaaaaccgatagaactttctgttcaacgctctggcaatagatttaccaatggaagtctttcctacacctgggggtccaacaaaacagataatcttaccgttgattttgttcaaaagcttaccaacagcaatgaattctagaatacgatccttgacgtccttgagaccgtaatggtcatcatcaagaacggtgatagcctttttgatattgtactcatccttagattgcttgccccagggaatttgagttaaccaatccagatagtttctcgtaacagtaaattcagacattaatggctccaaagtctggagcttggctatctcatcctcgtagactttcataacatctgcaggcatgttgaggtccttcactctatcgttatactttgcaattaatttatcccgaccgtcatcaattcccagttcctttttgatccacttgagttgctcatttaagtggtactctctgtgtctcttcgccatacgttcttcgatatctttttcaatctttctttgtaactccttattcataagttcttttttcaagatggtgaaagatttctccaatcttttctcaatatctaaacagttgagaatatcttgtaggtcgttttcatttccagctgttactgcagccgcaaagtcggcaagcttttcgggacattgaaaaacgtctttttgtaatgaagcgctgaatgttgccaggtggtcggcaaacattttattcatgttggacatttctttgagaacttccaagattgaggcagtcaaggagttgataacgggactgtctctttcatatggcagatcattcacatttgaaacatttaccaaggttatagggtagtttttcaaaaattctgtaggattctcatccttttcggtggtaacctcttgagcttcgtctgaaaccaaatcttcttcttcgtcctcaattgaacgttttggaccatctccctctttctcgccagtaataccttgaataatttccttgcgactacgtttggtaggcctttcggatgggacgactttggcagactcaacgtccttattcaaatcctccccctcttttggagggaacaattcgtcaatccgaattctcttatgagggtagagcacagtggttaacgattctacgccagtttcgctatctttactaaatacattggatgtgatctgggccaaaacaccaatttcatgtacttcatctttattagtaatgatatcagagtccgcattctcatccttgaacaggaaacatccaatgtatggatagcccttatcaagcgattctcttatggccttgatcacgttgacattggtgataatcacggctttatagaaaccagggaatagcggtcttcgagagataggcaaggctataatttggggatatacctctggtagctcgtctgctgctgatttctttttaggttttccatcatcattacctgaaggtggagcagcagtactaataccgctgctgctttctggagccaattttgtacgtttcaccgaagactctttcttggacttatccacaggatctctttccttagaaggatctttttcattgttgttttcaatgtctggctgctccttatcttcattttgatctttatcaacctcattttccacaatatccttctttgggtcatctttcagtctcaaagtggaaagagtgtgatggaactcttccaatggctgaagaggttgaagggcattacgattctggaacgctaattggtgagccaatctgggccctactagtttgaaggattgaccagtagccgccaaatgggcagtattcaccatacagcgtcgcataccttggtaatgtctcaacatgtgagtgtgatctggtggcaagttgagttgttgaagtttaataatgtgtgcctaatacgtcgcgcgcaggatgggaggcgggtaacgatgtcggatgtctgattccgaagaaaatagagtgcttttagataaatactaataattgtacacagtgtttttgacttgaaattaagagatcacacttcctttcctcatcacttttgtttattttccttaaaaatcattctgatacctgtaaaggacattttctccatgatgtccgttggctactagtgctatgtcttcgctctctgaggctatggcgttcgcattatcgtttaagtttagaccgagagcagcatcgtgatgaacgttaggatccacattctcctgtttaactagtctttcatttagatgctcaatgtcttctgcatgtgtatgaaccatggagttcggagcagctcttgcttgttcatcgtatccgtcaaaagttgggactgagaactgtacttcgttgttgtcatgatgtccactgttttcgttactgtgatgattatcgtcattatgatcttgattcctttcattatcgtcattctcataatgggaaggataaccatcctggtccaagtgatcagtggtatttttgctatgatgttcattgtcgtagtttactgtgtcttcgtcagggtcctgtgtgttgttaatgctagtatcgttctttttatctgccgcaaaatcaaaaaagtcctgcgcaggagttttaagtgatccgccattactgtctattgtgggcaccggtcttcttctcaggtcacctctttcttgccttaaagcctgctgttctctgtatttggccaaatagatcttcaacacttctgcatagttttcaaatcccagggaagccatactgtacaagatatcttccccatttattgtcttgcgcttttcgttaagacacttatcagatgcttctgaagtgatgaaagagataaactcagagacgcattcttgcatacactctttggcatccttggaaacttttgccgttgcaggcaacgttcctttcatcagtcgggccacattggcaataggcagccacctgtcctgttctcttaattctatttcttgtatactggacatttctgattgtttaaagagtggagacgaacatgccaggtataaagtgtcattattggtacatacacgacccagtttgattgttctgaagagagtcccccgctgcaggttggattcaggcgaagaggtgattagtaaggggaacttctcggcctggctttggctccctgtcggacccaccctttttgatctgcaccaggaacgcttatatctgcgcgactattgtgacgtacccactggagaatccacgtcaacacgttgtgctgctcttaccattcactatgtccagtcaagatgagctggataccactgctacaaaggaatcaaaggattccttttccaagtcggcgtctggggcttcatttctgatgctgactcaactttcttccaaactttgcacatttttcatcaaccaactgctcatgtcctatatttcagcacgtatcctgggtgcaacgagctacattgactttttagtggcgacttccctttttttcagcagagaagctgttcgtctgtcttgccagagaatcaaattgccaaaggggaaagcataccaggcaatttttaacctgtctttgatcccgttggttattggtgtgccattttcttcgatcttgatttacacgcagtttataagacagcaaaacgctgctgttttgcaatcacctttatttaggtattctgtcggctttatgtggctatccgtgattatagagctgttgagtgaaccattgtacaacatcaaccaatatgatctggacattaagacacgatccaaaattgaaagtttcgcaaatgtattcaagtgcctgagccaattgggaatgattgtatggtttgaacataagtttaaaggaatgtcagtagataaagccaatcctgattatttcattttttcgtattgtgtcagtctgttcatatacggaggttcgatattgagtttgtacctgcactttttctttaagtcatccgcaagatcgcaaatcagattcaagttgactaaaatagatgattggtattttgagccaagatctattagctattggaagaacatttttgttcaaatttttttcaagcatgttttaactgaaggtgacaagtttatagtcaattatctttgttctccagaagagcagggaatatttgcacttgtcaacaattatgggtcgttaatcaccagaatggtctttgctccgattgaagagtcactaagactatacttcaccaagctcatatcccaagattcatccccaaagacttatcgccaagtttgcacagtacttaaaaacatactcgtattctacaagtacctttctctattcattgtgatatttgtgccattcaattcaaagtttgtgttttctatgttgttgggaaacgactgggcctcgtctacggatgccttcaaagtttattggatctacattccctttttggcagtcaacggagtaaccgaagctacattctactccaccgttgaagatgccgctcgtttgttcagttactccaagtacatggtaatgtgctccattgctttcatcgcttcggcgactctactgatcaggggaactgggctctcagtagtcggcctaataattgccaattgcgtcaacatgcttttgcgcattatttactgttccaacttgattaatacgatggacagttcctttaaactgcatattgactcttctgccattcagaccatccttgtaggcatttcagtggcatcattgcattatttcatcactggtagtaacacagaaaattttgtacaatttttctacagcgcgtcgttggcatgtttaacgttactgttagttatcttcaaagaaaggtccttattgtcaaacttattccaccaagtttggaaatcaaaaatcaaatcgtcataatacccacccttaatattaccattacctatagaccataaaataaatacctaattctaaccctatcccataactaaaacttcgtaagattacctgaccactgtgtcctttcccttgtacctacatacaggacagttcctggataccagcatccagctttggatacaaatagagtggaaagtgtgatcacatcttaacttcttggcagttcgattgggagagtccaaacgatctaaacagataacacatttattatcaactttggtcattaatgataaatctgtgtcctctaattcgttgttaatatgcaccagtttgatagcatttttctgtaaccatattaatcgccgtgttcttccaatcaactgcctgaggcaaatgtaaagagagggtagcacatgtaaagctgggatagtaaaaaaagtgacaaacaacgatgaaaatagaataaacattccaagccgtattatgttcacgatgacatcgaccagatgaaatattctctccttgaggtctgacctgtaatcatccccgtaccttgaaggactttgtcgccgaaactccaggtaattaccgaggtaagtaattgaagtgtacacaatcaatgggtgtagattgaaaacttcaaatccaaaaatcaggaccagaagatccatctgttttgagttgaagaagatttcacggaaaaactgaatcatcagtacaacatccacatagtgtagtagtacaatgcccatggcaaatcgtaagtgcaataaagtgagatttcttccagaatgtttgtacatcggaaaaatgtttcgaactctgtccatagtcaagtaatgaaaactcttaagcaacaagacgctcaaaaaaaaccctccatatttcagggcctgattccagtcaaacacgtctccatttaatactcgaaccatgataagccctaatatgaattcgtacgaggtataaaacaggctatctttcaaattctggatttctgtgggccttagttcaccaaaaactacccatttaacaaacttggaggagtagtaggatgaaactaaaattagattgatgataccgaaccttgaataatctaacagtttgaagtacgtcgccaccgacatcttttggtaggacatgtaggcaacggttcctgccttaaaagaattgttagtacttcactaagccaaaattgtgagctttacttaccactcccacgctaagacttcttcgtctaactgtggacatgtacagtgtgttgtcttgtgatataaagataaagcaaagattatttttacccgcgatcgctggatatctggagatgtctgaactgaacccgaacccttgcctggcttcagcttaatctactcggaaaaactaggatcataggatacgcagtcatacagattgatctatcatacagtatatgtaaataaaaagtctaaattgatgttagtggtgtgaaaatactgttactcggccgattgaacaggctcggtagatttcttgggctcggcaggttcggcattttcgatgggttcagaaggattctcagcagcggtctcagcagcctcctggattggtgtctccttaccctgagattctggctcctcctggacaactttagcttgagattgcttttctgtctcaattccgtagattctatacaacaactcgaatgtttcctgtttcgaaaccattaggttaaagttactttttcccttccataaaggcaagaacaaagcttcctcattcgggtttttcctaacaacattgatcagacagcaaccctcgtcagtgttttcaatctgctttatgaactcaacatctagttctttctctttaatgccattgatgtttgggaacccttcttgcaacaaaatcagtaagacatcaagattgcactcaaacactctttctttggagatatgtttctttataatcgataagctctcattctggagcctccagggacatgtgtgctctgatttttgagccacgaaaagcttcactcctgagtggaccaactttaatctggtctcattagtttggatgacattctttactactggtgcaacgtagtaaatggttctaattggatcacctgtggcgtttctaaccaacgtgcatgttcggtcgaacttgtcatcaaatccataaaattcccagcatttttgcagttgctcattggctgggtccagaaaattgaatggctcttcattagcatctcttggtaaccgctgctttttaactgggttgaccgaagtattgttatcaactttttgtttcttctccgcctcttcgtctggttgttcctttctcttttcaccgatagaattcttatcgatcttttcaaaaacggtgatgaagaacccaccggtgttttgtaagtgcggataaactctaatgcatctgtccaagttgaagtttttggcctcctcctctgttggagggaacacagtagcatgaatatcatcagctcccttttctctgagttccatatccttcccgaacactttccaattggaaatacctggaactcttttcaatcccggaagacgatcactacagtcgacaagacgaatctgatcaccccactgtcttaaagctgcagcgactacagcttcgttttcaataggattcaaagaacatgtcgagtagactagacggcctccgcgctgcagcaattgtattcctctgttcaaaatattaagttgaagaggatgaagtccaatggcgtttccaggagtccagttggtccatacattgatattctttctcatggtcgcatcccctgtgcatggaacatcacataaaactcggtcgaatttgatgtattcctgagactctggagttagtttcatctttggaaacatttgagcatcgtggttcacgacgataaaattggcagaattcagtctcttaacttgatgcaccaacatatgagatcttttatagtctgaatcgttagccataacaaacccagacggctctttgtcttcagcatgcaatgcttcaactagttgagaagtcttggaacctggtgctgcacacatgtccaaaacatagtgatgtggcttaacatcaagaactaagggaggtatcatagagacagcttcttgacgtgaaatattacccacatcagtttctataaccaaaaatctttgtgtttttgcatagtctggattcttcttaataactcctttggggaggtcaatctgccatccaagatgatttggataccatggtagagattttggaggtgaataatcttcgtatccctcaatgttcagattagtcaggtttggaaggtgcttctgttcaaaaatatcacgaatctctgaggcatgttttctggtgcctgtgattctaaaagtaaggggtagagtttgttgacaggatttcttgaatacttcgaattcctcttcagagagtaaccctaactctttatagtaagactcccacctaggattctccttttcaatatctttccaagattcgtgaaagcctctgtgattgttgtcccgtttcccaaatttgccattgttggaaccgccttttttgtttcttctgaatctacccatgattgtgataaggaagcggatcatggtgttgaattttttttttgtctggtatttttcatttccgcgacatgatacccgattgaattaaagtatggttaaaccgttatcattcattaggatgtactagcaggaggccagactgttccatctgcctaagtactatggaaagggtgctcagagtgagaggtgggctaaatatcattgacctcttctatatcggaattgctatcaattatttcatcgaccagttcgttttcagtgacttttttatgtgtctcctttggggattctttggcagatttcctcttcttcttctttttcttctcttcttttcgttccatgtacatcttgaatgcattaccgtcaataaactcctcaacccaaccttcaatcaaagcgcctaaagaaagtagagcagtgcaatccatgctttgctgtaagttattccaccctgtttcaagacgttggttgcggattagcttcaaagtctcatatacatcattttccatgttcaatagctcaatcggtttcttggtgctcaccacgtgagccgtgtaataatgaagggcctttaaaagatctgagtctggtaattgagaagagggagcaaagctatcacgatcttttattgggataggtacttggaatttcacattttcagccaacacttcgtctggcggggccgctgtcctcactcttacagtcttcacgtcgtccttccatggatcatcaggggcgattgtgtctggctctcccgggtcatgcttctcgtacttccgttttgtgtatttcccatccactgcatcatacacattggcccgttggtatttggctctccctgacatatggaccggatgtaatgacgatggggagtaaaatgcggagccaactaactgagcttaacgtttttgaagagatacggtggtgattatataatcatactttttttttacctgcctcactagctgaccatctactatagggacaccagagatgagccaagatatgaactatgtagcccgggcgaatcaaacagtgtcggagctagcagccaaagtcagggaaaagaatcttcagttggaacaattagaacactcgtacaaaaataagatacgagcattggatgagtatttcaaagaattgcagaagaattatcctctccccatcaacgctcaaaaagatagtttaccatctttagaggacttggtacctccaaaatgcaatcattgtaatgaaatcattgaaatggacaattattttctcattcccaaaggatacaaagctgaagaaccagactcccccatagatacaccgtctggtgtgacatctcaaccaattcacagtacagcaacgagaccgcataagaagaacaagaaggtatcatgttcattttgtaaagaactaggtcatagcagaagagattgtcccattaaacttagtcaacagatatcctaataatacagtgcattaattatttacctatttgattccctgaactggccatagcctctaaaccaccgttagtaaacgcttcgcatcaacataaaaaattgaaaattcgacatacctcttctggatgcatcctgtaacaaattggtatctactgatgatgggtcaatgtgtatgtacctaataccagaacctctgataaacagactcttcacaccgaacagatgaggaaattcgttatcttcatcactgatatattgtatattatccaactttagattcagatattggtcaacagactttaaggttcccgttatctcaacattattcttgaactatgacattgttagaaaagagtttaaacggaggtaaacgagcgaaaaaacttacttccacggtaatctaaatagttagcgatgacatcccatactttaaagtcaaatgaacttacctgttgatcagttagggtcttgaatagggagaagaacaacatgatttatagatttcaaaggaatccagatgttcttggacagagatactctgaacgtatacatattgcgcgctacacgacaaaaaactgcaatccggcatcttctcgtatgacgatccatagtaaaataatagatgaagtaaatacaggggacttttaatatatacaagattgaccctggaaatgttctttaattcaaaggtttagaagcacccttagcacccgttttggacaattgctgtaatgaccgttttagtagagcaatatttgccacattcggtcttcgcaactgctgaaacaataccagtataccagttaggagccctaaagcaccagcttggtgggcagtagctagttcaatagggaccaaataaataagagttgtgattccgagggcagcctgtatagtcaccagtcccatacaggcgtttagagttctgtaggcattctttggaatgatgggtctcagccgatgactgtacatgtgaactgcaaatacagaaaaaaatgttgtaacagctaagattctgtggtttagctgaacagtagttggattttccaacatgtttctccaaaacaaatctgattggtcggcttttctagcaaatactggcgacattaactcatttgaagatggaatgatgtcatctcccatatgtgggaaagtattgtatataagaccagcatccaagccggcaaccagaccaccagacatggcagttataaacaccaggcctaatagaactgaagagagtctcttgaaagttttcaattttggagacgcaatttgcttgaaaatttgaacatacgcttcaggctgtttcatgatcttatagttcttcaaaacttgaagccctgtgtaaatcatgtaacagtaaataacaaatgcagttccaagatgggtagttaagcgatatggagacacagttggtttggagttacgttcagccaattgctgtttgtccaatccggaatacaccatccaccagccgatgaaaccttggaatcctatcatagagcatattgcaagcagtttcaatgcaacatctttggaacactttcgacgggcaatgaagtaaaacgtgggaagaacaaacgacaggccgatgacccttcccaacaatctatgtccccattccatggaaaatataaacttgaactcttccaatgttatgtgagaatttagttcctgaaactcagggctttgtttgtatttttcaaattccaacttccagtcttcctcagtcagtgggggaaccgaaccagtgataggtttccactccgttatggaaagaccggattcggtcagtctagtcaacccaccaacgacaacaatagcaaataccagaatggaggtaccgatacatacgtagccaacacttttatgggaattaataggccatttggaactagtttttgcagactgggctttggcaacctgaaaaccttggttcaacgcagcactttgactttgaaatcgggatggaagggtgtgaaaccttctgactcctctgttaccgcggtgatcggcgagcaacttcttttggctgaagagaaactggtctacgggtttcttggaagttgatgcagtgggaagaattttacttctcttggaagcacccaagttgagtgaaatctgagataaatatggtttgcatgtgctcaacagggaagtattcttcaagaagaaaaaacgggtctttgataaagacatcttgtcttgttaacgaagcaaaactgcaagcgtgaatttgtatgatgacaaaatgggatgatctcgctttcagcttcttttttttttttcatccagtagtttcacgagccagtagcgaaatgataagaggtaacggttccagcagtacttcgagtacaccatgagtgaacaagatctgagttacgtatctagctcaatgtctatgcaaatttgtccattgctcttacttaagtgctattaggctgtgcactagataaaacgagaggctatccaattctttgtggattacgtaatgaccatcaatgtccaagtagaagataacgacttgaggtcacagtccaaagtgaaatttgctacgtccactgcgtatgtggatacgaagcattcttggcaaattatttgggtagggaatagaactacgttctactgaaattaacgatgctttcgattaacccctacattttcattctatgtaccttaacactgcatagatgcatataacggtcccgtcgccaagacccacccaaactagactcagaattgattgtattctacaacacattctgaaactagataacgagctgcagtatttctgatggttcaatcacggataagctgcgaacaccaaaataaggacttctcaaatcaccagaaaaaccgttagaaaagtccaaataagtgtacaagttgtacagaagaaaccatggaattttgatccatacgagtgagcaaacacccatcatatggtatgaatataagtccactactgtcttatttttagatcctttttgtcatttgcctttttttcagcctccttcttttccgcctccttcctttgtttctccgctattttcctgactctctcctttctttcttcttcttccctttgcttctcttttggatctatctctttattcctctggcctttttcaagtttttctgtgatttcctcaagtttctttttcatttcttgcagcttttttctctccgcttcttctttctctttctcctttcgttccttttcttcaatcttcttcttctcctcttcaatcctctttttctcttcttcttctttttctttctttttctttttttcttcttcctctttctccttcttctttctctcctcagcgaccctccttcttcgttctgcctccccacgagtaagcccatattctttacaataacctttggcagcatctagtgcacatgattgtacttttataaaattgtttaccgtggttttgttgtcaaaatgtaagtcactcaggatacgctggaaattatgttcatcctctgcttctggaccttgatagccatccagttcagatagatagttatacagccctctgatatgaatcacagaggtactcttgtccgcctcactgaatgacaatgtcaagatatcgtctccattgctatctacgacttcccagttatcaatgctatttgggattaaaacggaatggtccgcactgcatggtaatccgtttcctgaatacggtaaaacctccagaccaaaatcaagagaggtggacaagagttcaacaaagaaatttgaaccttctctgacaaagagcatcagcattggtctgtatgtcgtcctggagcaaccacaatttgcaattctcgttctggggaatgaaacccagatctctttgtccttcgccatcggaattgcctgaggaagattgatcataggtgtggcaccacgcaactcagacgacatggagtcaactttcggtatctcaaacacaatatcacatgagccgtcatcaagactgcatttgagtactctcagagggttgaaagagtaaacaaaatgaactgcctcctgattgtcttttaagaaaaatgggacccagttcttttcatacctgggcatctcatagtctttaatgtcgtacatgactgttttgaactggtcaaatggagaaatggtaaaaattctcctacgtttgttatcttgagttagggagttgaacatcaccaaaggatcaggtccaaaacggccctttctcaaaacaactctaggatcttctgccccacgaaacttcttacctttgacaaaattggttgcaataggaagaacttgtggaaacgtgttgtgctggaccttcccagtatttgggttcaggatgtccaagaaatggccatttaactcgttccagtttttgtcatatatctgagcaactatgatagatgttactggagagttcgcctttccttcagccgaaaagatgactcgtctaaccaggtaatgcacatcgtgttcgggcagaaagactgaactaccataaaacgtaaaccagtgtttttcaaccttttgttttacagtcaaggctttatcttctaagtcttttatggcggagtaaacgtcaatgtccaaaatctgagctcttatgaactccaaatcgcaagctaagtcatgctttggggtgactttcaacaatccatgataagacaaatccgtacatcctagcactggagcattgtcgtagatgttggtgacataggagtcgacctccatgtcgttgaagcttcccaatgatagcagatcatcataggcagaatccttgcctccgtttagggagattccgccaagattattatcattccaagtaaggaggactccgatccaaatcacagacaaaacactggcaatacagagcagcaggaagttgagtcgtgttctcatccaacagtatcaggcacggtatagaagcggagatgaaatagaccaaccttgcttgaggctaagggaaaacaaccaagaaaaaaggcgcctgataaattgggccctcaaaaacaatacaccaaggcgcacaggcacctgcattcaattgcgacacactttctcgtttaagcggaaagaggaaggtttcattccgttgtagggaagtagccacataagtgcacagcataccgtgttgtgcctcggcaatttgttggtacggtcctatacaatcttatgaagcctcctgctacgctcagaaatgccaaattgctctctgagacaataaatccgcgtagttttgaaatttgtagtgaaaatctaggcccgctcgcaggcgagattgacattagtagctgcatagggctgaagcatactgtgcttgcatcacataatcttggaattacattcatttattagacaaaaatttaaattaagttattttgtggagcccaaactttttgagtttttgtttttatttataactgtgaattctacgacaatattaccgttttcaggccattacggtaactctagcttttttaacttctttcttcttcctgcaattgatacagtttcttctttgcctctaacttttcagcctcctcctgctcctttgcaagtttctccactattatcttcttctttgcttcattctcctttgcttccttttcctttgccgctttttcctctgcttccttctcctttgcttcctgctgtgctttcttctcctgttcggcttcctctttttctctctccttctgtgcaatggcttcctgtgcctttcttacagcttcttccatttcagctttctcagcttccagcttctccttggcttctttctcttttttctccttttccttcctttcattctccatctgttttgcatatctggcaggctcaccacgggtctccccgtacttcttgcagtagtccctactcgaaaaaatagcacattcagcagccttgactgagttcaacagagtggtgtcacttttaaaatgatttgtagacagcacattcttgaaagagtgactatcatgtataggtccctcaccgtttagcactagcaagtaatctaacaatccctttacatgaacaaccaccgtgtttctgtctgcctcactcaaggtcagagtcaagatatcagactttcctccttgcttcttgcttacatcccagctgtcaataccattggggatcaacactgaaatcgatccagaacatgactctccctttgcatcgtatgataatacgtcaatgtgaaagtcaatggaactggaaatcaattctgtgtagaatttattgccctccttgacaaaaagcgtcaatactggtcgataggttgttcttgaacatccacagtctcgtagtctagttctggggaaagcaacccagacctccttacctttaggaagcgaaaggtgaacaggtagtttcaccataggtgtggcacctcgcaactctgagccaaaacggccttcctctggactttcgtagatcatacgacaggctcctgtgtccaagctgcattttataactttcaaaggattgaaagagtacacaaagtgcacatatccagtgctgtatttggaaacttcaacatcgtccaagaaaaatggggaccaattcttttctgaatttggtctttccttatcttcaatatcaagaagatttactttgtcggaccgaaaaggagaagtcacaaacattccacgcttaccgtcacacaaagaggactgcaagttaaatagcacaatgggttctgatacgcctgtctttgaaggcttgaggaaaactctaggatcctccgtacctttccatttatcatcaacgctccactcaatggggacgtgtatgagctgagggaatgtttggggcgtgacattgcctgtggctgggttcactatctccagcgtatgaggcgttaactcattccagtctttatcgtaaagttgggcaactaaaagcgagatcaccggcgtgtctgctcttcccaccttgctgaacaaaacacgacgaacaagatagtggacttcgtgttcgggaagatagacagaacttccatagaaggtaaaccagtgcttttttattctctgttcctctgtgatgtcctgagcctccaaatcggccagtactccgtattcctcggatgaaaaaattttcctcctgatataggccatatcgcagtccagttccttcttcttactagtcttgactagccctttataagctaagctgtcacacgtcacggaaattctaccattagtatccgaaaggaacgaatcaacgtttatgtccgtgaactgaagcgaatccaaatatgattcattgaaaactgtgggcaccactgcaggttcccaggagggtgaacctatcacggtgctaggagtgaacttgtagcccaaaaatacaaacaggttcaaaagaaccaaggttatagcaacctgaccgagtcttctcatgctataaaatttcaaccactgaaacagatcgaccataaaaaggagagttagatacagtgatgtatcaatgaaccaagctcaatgatatgtacgttcccaagagataggacggtggtgttttaggatgaaagaataacaatctcaaaatttgaaaggttgtggtcttagcaaggtgtgtttttgttctttatttttctcgccttgcatgcatcgataagtgctgctgcgcctgaattttatttctgcgcccagccatacgtgagtgccaaccctcaactagagtccccctaaccgaactcttaagattcacgaatggtacaagatatagagataagctgtcctgtattcactttatctcggatcctaaaaaaaaatgtgagccttgcaacactgtctttatgacagcagtaatcgaataatttgcctgggcgaaaaatggccattcgttttccatttttggcagcttgcatataaaacacctcgcctcaggaaagcacgtggtcaacataagtttttgtgagattggagatatccggaaatcttaattcaatagtcgagctgcaggaaacaatgcgaagctcgaaaacatctagttgtgcagaacggctctcaccatatgcgtttatcatgcatttcaaatctactgacctgagccaatgatttatcaccatcacgattcgcattgtgggacctttgttcttctttagattgcggcattttctcgtctgacccatacagcagacttcgtgtatgaatgtcttcaatccccgctaaagaggtgttaggtgagccctttagatagtcgccaccactaggcgaggtcttggccctagtgttgtggcgtgcccatcttatcagcatcacgtaagtgctcatgcgaagaaggatcaagatgacagccgcggatgccacggctaagaggacactttgatcaaaattctgggtactacaggcttttcgaacgctggaaatcaccatcttacagaatgcaacagttatcggcaacaatggtaagcccaaacgaatgttcatggtagcaaagctctctgttgtcgcaggtgggttcgtacagtccgggtcattttgccggtactcacgtaggaaatcttggcttagtattcttgtgtaccttctgtaaatctgaggttttatgcggttgaattttccaatgtaaagatgctttaaccaatcaaccaataattcagagccgatcaccgcaaaagacgggcccatcagcatgcctatccaactgattaccactggagatatggctatgttttcgcccaaggagcgtgatctaatggagaattcagtagacattaataactgtaccagatttcggacactgatgatgaagagcattagaaacagttggaatcgttcatatagatcagcacatgccatctggaataaaccttccctttctaaccgtttgaatactgcggatttgatttcagcaaattgcacagagagaagcaacgtcaacagagcattggaatacgaattgacggcgacgttcaacgacataatttggtatacgaagacacatgcgtgaacgctgatgtaggttgtgctcagcaacgcaaccaggaagcattttcctgcgcaagaaaggcttctttctaatggaaaattgaacgacacccttaatatgtcttgacccagagatgataatagtttatcggcaacttctagtacactcaccataacatacaactttatgacggtaccagctttaatattgtggtaaatcttggaagtatctatactggaaatggcaattgaactgctcaaaagcaacaaaatccatgttacatcttctcttttgaatctgtacctgccggggacactattcgtaaacgctgcacgaagtttcaggatggataccattagcaccctcaacggaatgatcgtcaacaatgtcagaaacgagtttaaacaatagaccaacccaaaactcatgaattgttcaagatagaagggcactgtgtagagattggtcaaatgttccaatgactggatgtactttaaatctggggtcgttctttctggcttcgaatccaaattcttcctaagctcgttcttgaacagcttccagaaggttatatgagtttccttatcacttagtgacgacttcgaccttggcctttgagttggcttcacctgctcaggcattggatgtggtgtgctaactatcggtcaagtaactaggaataaatttagggtttctcctccttcgctaggctcgatctctcccacgccgatgttattctttcgctgctcctcctactccaatacccacctatcaaccccagattacaaccattttttgcagaccatttcaaccacctctcttgatgttttacggcattcaagaaattgccgatctactttcctccttccattcaaggtcgctactgactccacccgaggccaacaagctaacactgaccctgttggagtgtctcacggagaactataccgatatcactacattacgcttcctgagccggttccttacaaaggacgcgtacagagaactgaccaaagaacgcataataacacatacatgtgggtatcctacgtgtagcaaacactccgccaagataaaagaccggcactacacaaatcacctagagttgcccaacactttcaccaattcatattgctcccggttccactaccagtgctcggagttttacttgaaccaattgtccaacgaagcgttatttgggcgtaaggatgtaatgacattaccctacaatgatgagagatcctatgaaagcaagatgataatgttggaggacatcatctcgaacccaaatgttgtggatagtgataagatggacgatatgataaggtccatgggcgatatcaacatcaaggatgataagaaggtgagtccggaagactggatggagatgttcgaagacatcaaaattgtggagaatcaagatcccaagaaagagggtgattttgagcaaactgaggacaacaaggattctataagtggagagggaaaagaaaatcctagaaacattaacaatcctttgaacatagagggctacacgactacaattaaaaactgaagtttcatctctcataggacattaatctaagtgtttcccttcaatagcattttcttcattatcagcatatctatgtcagtttattcccaacaatgggagtttggtgggagacttgaagttgtaaatttccaacagttcgcccagatcaatgtctgaatgatgtggatttagttcataatttttcaactctttaacgagttgcgtgaagttggcctttctggcttcatagtatgcatccaattgtttctgtgttaaatgtgatatttggatttgtcttttattatattcttttatttcagagaccagcttggacgattgagcatctatttctttctcagcaattcgaaagacggaaagccaatcaccatccgaatgacccgttaaccgatcccattgattttccatatcatagtactttttcatcaaacttttgttgttggctagctgcgttgttgcctcattaagacgatcggtttccaacatcgcttggtaaagaaatcgtctctccctccataaccctccccatggaactctaatcatataggcagggtactttagcccagatttataggcaatttgagctttatagggtcccttctgtaaagttgtctttaatttatctatcgcctgaactcgcaatttgaaaagaacctccggttgtgtgatttctttgagataaacggtatccggaggagttttagttgacatgagattttcttttctcttatttttaatttccttttgcatccaatcgtttagtttctgtttttgggagtttcttgcttgaatgtcttgaatttccatgtccgaacgtacagggttcagtattggtgtctccaacttggcttctgcagctggagccagaatgagcttgatcgaagaaatcaattcggctatttcttgagacggtgccccattgagaatggttttggaaaacttttcgtttaattcctcccctcgcaagagaagtgatcttatcctgtggcttcttaaatctattttgaatcgatgaaagatctctcttaaaagatcagaaatggactcatcctgtgagacaaacctggctttccgtatgagatttctatataatgacaggaccccatatttgtgggcctgaacttggctgaaatgaagtaccatcagttagaagaagtctctcgctgaaaagtgatgagaagataaatcagaaagtgaaaagtactagacgagacttgttgaaaatgattcataaccaaatttgactagcaacaatagagcagaacaattcacaagatattcatcagcaagggagtcgttgtctgaagaaatctattcactccatccaacttccttacttacttccgccgcgaactattaggttacctttcctcttctcacaatcaatcaccatggtaagtagaacaccccaaaagtgacattagtctgcggtttctaacgtctaagcccccgaaatccaagaacaacattcccgtagcggttacggtaaaaagagagaatgtttcggtggtccacttgttcaaaagatcccagactatctcagctgtgaaaaaacaactatgtgaaatgctcaattctacaggtggactcagcaatgacgccgacgcaaacatcgaaggcaatgaaattcagattccgaaatcctcatttgatttatccgacgatgaggatgacgaggtcgtctttggcgatgataacgaagggcgggctgaaccatccaatgaatccaacgaaaccgaaaaattgaacccaaacgctatcaagattgctctaatcaaagaattatcgccgttacgcatagaacttttggaaaacactacgaaaatccaggacattatcgaccagaatgatagagaagtcaaccttgctgtggcactggacgacgaagaatttaacgtcctagtgcccagccaagaagaacagtgactagaacataaatacagttgaaaaacacgatcctcatataatacaagaagtgatattaaaaaaactagagaaccagtttgtctagttaaccaaagtagaggcggtggcagactcgtacttccagttaggtggcaagacagaaacagttctgtagtaacgagccagtctgtggattctggactcaatcaaaatcaatctgaacttggagtccttgtcctttctgtttctctccaagtgctttctaacggagacagccttcttgatcaggtagtacaagtcctctggaatagcaggagccaaaccgttagacttcaaaattctgagaatcttgttaccagtgatgaatctagtctgagcaacaccgtgagcatctctcagaagaacaccgatttgagaaggagtcaaaccctttctggcgtacttgataacctgttgaacgacatcatcaggagtcaacttgaaccaagaaggagggtttcttgagtaaggaagagctgaggctgagataccttttccctaaaagacatgttagtatcaaaagaggagtgaaaaaacaaacctaatacattttcttcacaaaattggtaccaagcagcaaacggtggcacagagattcactctcgggagccaccaaccgcatttggccctaacttcggatattcttagtgtattatggccatcatggtttaaatctacgcacgctgctgtgcatacgacccatttttgctgattttcttgtaagacgtagatggaagaaagacgactgtgaaaatttagcagaaatccatagactagcgaaaacgaaaaaagccctattattggtcatgtgacgtagtttagggtcgaaaccacaggttgattctttaactgttatgcttaaagtcgtctagtttattgattgcaagtcaatgtaagagtattctgattgcataaggcaaatgcaatggcttgtgaagttaatggctctttctaatactttaaacgtattttcttgaacgttcgttcgaactaatccactgtagatagtggtagtaatggttggacttgggttactgaaaccagcaactccatgttcaattcatgatcatcactacttctagcctttctttcttagcttctccttcccgtttcctattcttcctttcctatccatggtcaaatacctgtccagccatctcatcaccaatcgagcagtaaacaattgaccttccgcttttggatatatgcacatatatatatcacatccgaccgttcgaatcaagacagagaagacccttggaagcactctccagtagcctcacaattggatatgagcagatatatcaacgaacgagctgcatatgcacaagtaagtattgcttggtatccttctatcacccattcgttggtggaacaaaactaacaggttgtccagctcgtaggtgattatgaatgccttatcaaggaatttcaaaacccagatgttgaggagataggtaactacaaagttcttcgggtgttaagtgaggggcctttcggggtcgtatatcttgcccagcataagatgttacactataaagtggtcctaaagaaaggggaaagagatttgtcaaaaaacggggacaatatcatgagggaatgttactacctgagagaatttaatcacccccatataacaaagatctttgaaactatttttacggagaactacgtctacatgtccattgagtattgttgtcaaggagatttgtttgattatttgagtaagaggaggcagattccgacagaggaggctgtcaagattttttcccagctttgcggtagtgttcattatatccacaaaagaggctgttgtcacagagatttgaaattagagaatatattactagatgaagacaacaacgtcaagttatcagatctcgggttcacccgagaaattcctcatttttatcccaatggcaatagtgctcctaatccacattctccacttcataccttctgtggtaccacagtttacatggcacctgaactaatacggagagagcagtattctggtataagaacggatctttgggctcttggaatcatattgttcaccatgctgtatggagagatgccgtttgacacggaagatgaaatactggagcaggagcccgtttataaagatttcatttctccgagcattattgatttgttgaaaactcttctaaagaaagatgcgaaagagaggtttgattctctggaagttgttttgcaggctcctgccttgcagccttatggggagcaacaactacaattacttcaggacttgagaaaacagaaactcccagatttcgattcgccgttagaaagacatttactgaaaaagattgacaggattggcattgatagaaaacttctcaagaagagttatagaaatagacagttggattctctcgtggggttttggaatatactagttgagagagaaaaacatcaatatcacaaaaaaaagagacggaagagtaaacttgccactcggagtcgaagcatgctgaaactaaattctaataggagtatgaatggaattggatcacgggacagatccatgctaagtattccggaactactacaaaacttgcaaattcaaggtcctagaaaagcagccgctattgagaatgcaaatggaaacgcaatgacaaatggaacttcagaaggacccgtatctgaatcttcaccaagagaatcagatgactttgcctaccctcatcagaatcatttattcagaccggcgagctacaattcgatattgagcaacccatctataaaacagaagctttctttaaagtactggaaacaaaagctcaaacagatgaaaaatgggagtaaaacttctttgaatttcgatgagaaaaagcgcaatccctcacttgttgattcaaggttggatgttgctaatccggaagatcgatccaaaattagggacaacacgcattttaactcccagttgggatccataccagccggggagcctaccagtggttatactcgtcaacgcagagcctcggggagtggaagcataactaagagaccaacttcagtattttctgccttctcccagttctctgagacttcaggtggatcagattacaatgctggatactctacggataatacagtacaaaacacaagcaatattacagatagaaatcctaatgcacagcctgtctacaataggtcaaaatcaaatgatggtttattttccaccaaatcgaagcaacctgacaatttgactttggaatccccaacttcaaacacagatctctctcggtgcaactcactcgagtcttcttcgattagcttctccagtaaaagaggtcgaagaagacacaactctcgtctcccctctggatcggtcatacgtaccaggagaggatttgattttattcatagaggcaaatcgcctcttgggttttacgaatgcgccatgttccccgatagaaacaaaacaagggttaatcaaaaaccaattatagttgaagaagattccagtaagttctttgaagaggatgaagaagatgaagagggtgaaaatgagataccaaatggttctcagctggaacctcctattcaactgatgaaggttgatggcatgcaaaacttggtgaatggtgtggataccgttggcgatgtttatgaagatgaacacgatgaagaggatgaccatggcttggagattaaaactactcctcgtatacatcttgacaccagaccagtattgcgaagtgactctaaagtcatttatgattctgcatccgactctgccactacaggagatgaggctgacgaagaagatgaatgtgaattggaagatgaatcaactgtattacaaaagggcccctaataagcatataatatgtacgataatatcccactctaatgcttcatagatcttagcaagttctgaattaatttgaactgctcagagtcaattttttcgtcctcgtcgtctgaaaaatcttcgtcttcaatatcattatctggttcgtaattaatgagtgtttccatcgtcttgtcgtccattttcagagcctccttgcagaagaactcaaaaaagtcatcctcgtctatatcaatgttctcctgtttaagatactccctagttatactgtcttcatctttctctgcttccctttcaccggacgaaaccggtacttcagcattatcatgttctttctcatcgttaactgtattcgtggtatcactttgtctattcagattgaagaatacttcacggaactcctctatccaggcatcatcttctccatcttgtgtcaattctatgtgtttcggcttaacgtgatgagtgattatttcaagacgcttcaactcagattgcagaggatctcgaagaattgtctcattgtgctctgcaagctcaacttccgatatttctgtttgttcaaggttcaggtcatgttccttcagatacgaccgtacactctgttggaggatccatccttttttctctaacgccagatcctcgtcaaacgaattagttgaaagatcaagatatgtgctcaagagataaggaagttgaatgtatatcgtcttaggtgtgtcaacaacattagaggctggcagaaaggaaggatgcggatgtaatttggagtactcgttgatggcttgtgccatttgagatggcgataggtgcgatattatcaacgaccgtgtcgatttgtcaactaatgccttctgggtatgaattaactgcagagctcttttggggaattctgaagtgatacttgggagctcaagtttgagacatttgaagggatatttcaagagaaattctaaggaatcttgaagcttcaagccactacctggctcgcaagactctggtatgaccaagatctgccgattattaatccagcatctgtttcctccgttggatgaactcaaccacttggggatcttgtcgtgtaactcaatcagtagaatttcaccgttttgatcaaacgcatgaaggtacagattgtcatctctggacgtaaacttggtgagaacctggagcaaaagccatgcatcctcaaaagcatcctggtaattcagttctccgtatatatagtggtaattatctttcctatccacaaccatcttgggtaaggcattcaaccatgggtaatatttgatgtacgggtccagctggatcgttagttggtcgaacaacttgctgagtttcccagaaatatccgtctggtagggatgcagatagaaaatggtaaagcaaacggtgtcatcgtcaaacaaaaagtcaggcttagcgtactcccatgctatatcgggatccatagtaaggaacttcgtgcacttgataacttgataacgatgtccataccacatgcagatgttctcgaatatatattttttggcattcaagctctgcagtcctcatcttcgcctcgtcttcctctcattatgggggcaactatagatgaagacatcaaagaacggatatggaacggaaaaatcaacatcaaggtatcattagccccgattgatcataaagttaatgcttcccagatctccttctacacaagattaccccggaattcgtttctacctatctatctacctcagatgttggatttttttgcttccagtatcaaggaccctgagtgggccaatcaaggaaattggtggttctctttccaggatgtaccaattcgttggaatttgccgataggtgtgaattttgacatcatgaccggactaaatcctgatgaaccaacacttgaagagtggaacattatcctcaactattcaaactatccaaatacaatcgtacccatttttaatagtaaaaagtcaaacggcgctaactttcatagacatgacgaccgtattcaattctttcacgtttactggctaaaccaaatgaaagaatcctgttattgtatcaatggcaattgcaactccataatgagtctgagcaaaacagattccaacctgttttggggcagtcttttatctcatgccagagataccttcatgtcaattaatcagaaacatgtgccactggatccgttgaacatccgtattatcccaattcgcatacatatttcaattttgaacaaagtgattcaaccaaacgttactcctacaaaagacgatcagaaagacctcaccacgttaggagatatcctgcaagagaccattccagaactgttcccatcatcgctaatgtacactatagcgtttccaatcacccatgggattaaactacctatcaatctctcattaattgatttgtattcgtattttgccttttccgatggattcgtccacatcagtgtggtatttaaccagcccaaaccgctatacataatttaaaattgctattttattagtgacttccggtgagctgaacaagtcaggcgttaacatgacattgccaaggatagcgcaaaggtttaaagatgacaaaacatgcagagcacaaatttaggtctttgggctttttgttatgatgcatttggaaaagctgtctatgacatttaggctgattcaaacactgcttgaagccaaattcggtacattttcaattgtttcttccgattcacgagtaatcttctgtcggtgcctatctccttctctttgaacacttttccaaaaatctctctgagctcttcctctgtgaagaaataaaccctagttccatctccacgcacatagaagttgtcatctaataatctgttctttttgaatctaacctgagccaaatcatatctcccgtagtctctgaagagtatgtggcctccgggtttcagcatcttctccaaattctttactgctgagtcccactgatctggagaaagagcactgaaaacaaacaccattatgattatgtctacagaatggggttccacaccttctggaagctccaagtcgggattactcaaatcccacacacatgcactagcgtattgcgggtcgaaatcttcgttttctttgaccaattttatggcattcttagaataatcagcacccacaattgataagtccttattcttattttgagttaggattggaaataaagtattaccggcaccacatcccaattcaacaattttcactggaccatagtcttccttcgtagcttcatataacgagggaaactcaatctgtaaccattttctgtctttgaaaaagttctctttattgtttcgatagaaaatgtcccaatacttggcaggctgagagttgtacaaattcttatcaaactctctaacaggagcttcgtattgcttctttatcttttcctgtgcctccatgacctgttcgtctccccattcaacatggtcccaggcattatgtttgaacacatcctcctcgttattcaagtaccgttggccaaaagtaaatggatcatcccttccaatcctggaatctaagggaggtttcgtttctgaaacgcctgcagtggggtcggctttagacattcaggtggatcaagtctatcagttgaaattctgattgttctcacagtaaaaaaaaaaattatataactaccatccgtacaccgcatatttgtatgcaatagaaatactaccagtattcaaatgcagcacttatcacaaggtgcatacaaagatggctggtttctaggcatatatctcaagactcgtatctcgtccattcgttccccaacatagccacaaaagcaagtactttttatccaaactagccgcaatatccgcaaagtacccaatggtcaaccgaatcaactttgaggacgatttggcccacgaatttagtcagtttgcaccttcgttggtttccaagtacagacataacctcaaagatgtcaagggcgtcgataatggcgtttccttggaggaaattccccgttctatgatatacaaaatgtttgtaaacaagagctcaagggacaagagtgtttcgcatttaagagggaacagagtgaccagttgcgtgccggagttgcagttctatgaagatctggaacccccagttttaccgttcaaaagcgagtatagtgaggaaagttacaatttaaaacacaaaactgtcacaagagaagctccgagagtacttggaggattttcagaccatgcccctaggggtaagtccttggcttcctcaaagaattccagccagaacataaaacagagaagtgtgtcaatgtttgaaccattggggaataagaaacaagatcagatgggactaataaaaaaattgaaaaggaactcgaagacacttgaaggaaaatcgtcttcacaatcttctcagaggtctttatcaagtgaaatattcaaattgccaatcaaatccaaagccacatcaactcaacaacccccaattcccgagtctctaaggtgtataccagctccatgcatgcttgaaaagaaagagcaaagcttgacatcatcacgttcgaggtcgacttctactgctccaagctcgttacgttcaaacagtacaaggaataccatgctgaagaaatcaactaaaccgttaccgttgccacctgtcataaaagaagactcttctacagtatcgtcaacagattctctggacaagttgtttgatctctattgttccactacaaattcgtcgactgagagttcaataaaacaaagtccaacattggaaaccagatcatttcatgccaaaattgactcaggttgctcagctccaagtactgagccaggcctctcttattgctgtagctcagccttggattctcaattttcttttgaagaggaagataaactgccaattgcaataaccacaatacctggtaagagcttaccacagctaccagtgaagactttctctcaaagcgaagtcagagattacgaaaacagttttaagccaaaagttttaggaattggtattccacctcccttacctcgtcatttccgtaggagcactgagatagaagcaagaactgatctaggaagaaagccttcccaagtaaagcaagatggatcagatactaaaatattcacaagaaaaccaagaacgcttaaaaaagaattaaatgaaattatagagctgccagaacattcaggtagcgtcaattccatcattccgttcatattagctgattacgacgagaaatcttctttaagggtggtcaacaggacgactccaacgcagagtcgagatataactcctagagcagttgaataagggaaacggttaattgtttgaaagaaagaagggttcgggaaataacgataaaacaccgttacaaggtattttgctcatacgttctacgaaaatggctttcggagtccaattgagcaaatcgaatctgtcttcattgtatattacatcgttatttagtgtcgataatgaagtagttagtcacaaaaggtaatagaaactaattttgcaactgaactccccattgcttagtacgggtgtattggtctggtatcacatttaatcccgtttccttcgcatccagtgcaagaatcggcctctacctttgctagttttctcgtcttctacggaagatgaaagaaaggaaaagttgaatgatttggaccttcggtgattctttgaagtttcgctcttcttcggagatattacattctctttccctttttctctttctttgagaactttaggaccaggttctccaacgctcaacctgatatcagcataatttaaagtcattggtttaactggagacatggacttccgccttgaagaaaccgacttttgccccgtagacaaagatgagtgcgaattcaagctgtgctctatgtccatttgaaatatagagctggaagggctcttttccttttgcttactctcaccatttaaatctggtgacttgagaggagtggtagacggtatcctattgacatttatggctggttgtaattccaacaactgtaaagagggaccattgttaatgtgtttgttggctacagtcttgttctctgtgacgtctgctgctttatgaaagcttgagatggagttcatgttactattgctattgtcatcttcttcttctatgattaaatgactgtgaaacttcgtgggagagaaattgaaaaattcaggtgcgctctctgttcgtttgtgcagtttagaactggtatcttggtcaagacttaaagtcacgttacgtttattctttccaatgtcgtccaggtcaattaaagcggccggaatgtcattctcaatctttgtgtcatcggacagaaagaaccgttgacgtggagatttgtttgaccttggtgacctaaacgacggctcgtcgaatgttgacgtgtaattctcatgaggtgtgatgggagtctgagaacccttactaggagaatacaaaggcgttccttccgtcttattcgaaaaggtaaacttgggatttaagtccagtgcttgacctgaccttaaaggggatccaatgttgaactggttgttgctgttggacggggacctataatgcgaatgggacaggtcaccgccggcaaattcggaaaggtcaaagtcaccagatatagccgtggatcttttgtgtctatgagctttccgaggtgatagcataggtttaaacgagtgactggggttgagattggcaaatgaaagctgctcgtgttgttcgttccgtactcctaaaactgcagacaaaaaaaaccgcgggtagtgtaccggataaatatgcaggatttgtcttgtgggtggttgacgcacggtggataatttggaaggcacggattattcgttttcagatctggttgtcaagatggtggaacctgaaagtacgagattttgaacaagaaccagacgactgtcaatggaaattatcacacaagggtaaggctggagtcaatggcaggtagctacctccttatgaatgataactggatgtctattccacttttctttttgctgagtcctctagatgtaatacttggcatgcatgaaaacttattcctctgaaattgtttgtccacgtttttcatgccatactcgcttgtggagattaggttgataatgcacaaaatgcacacaaaagtgttctctacaagcagctaatgagataaattgcccctagtccaactagtgacaatgtcgcaatatcaatatgcttggcataggtcgaatctccaattggcacttcgtagacgtcagaattattctgccagtgacccttcgcgtgataaaataaggttttattgtcaaaatacctctcgtaccctagcgatcgtttctggaatacatttcgctccaaaacagcttgctcttggatgtcgatggagtcacacgcataaaataggtcacccaattcaaagtcaatctcactatattgggtatctttcgcaacatctccgtatctcaagtggagcggaattagggcttctccttccttatagttcaatatttccatcaagtattcactaccccattttttcacggcccactcaggtttttccagattcatttctccaaatcctgcaaccaagttgacattttcactttgatcttgaatcatgtaacgatcgatgaatgaatgtttcgaaagaggagtgtaatagaacaggcgacataacgactctccttcttgaataaatggtggtttcacattttccaatcctgatagtttcagttttggatgcattcccacatgctctaaagtccctttgaaagatatctcgtccggtaggaacctgtgccttggtatcacttgaaataaggtttctagtcctttacctgggggaccttccaccgctggatattggaatctaacacccttcaaagcatagttctcaatattactcagcttctcatctaaatgcaaaattgctacttctgtctgtattccgtcttcttctttaatgttcattgtagattttagcggataagaaacatcgacgaacactttcgaatcaaccaactgtatatcgagaccgtgcacctcttctattttcagctttctgagcagatccaagagaggaagcaagtcatagttatcaattctcttcttatggtagttcacactaaacggtgttactataaattcatctccctgagcgccaaattggcttccaattttgtcagcaatggaccaaatttcattctgatccatagttagtggtacaaagtaggcattgaagccagaggccaaatggccacaaaacatgttctccgactcaccagccagctcttcatttctataggtgattctaaggctggcaacacgttcaacaattgactccaatggaggatacaactcttttggaaaggttaaccgatattggatgctgattggaacatccttcgattcagaaatggttatttcagtttcttcaggagagaaaagattgtagaatgaatctgctttcagttgctcctttgcgtaaaaagtgactcttctctccatagtcgacaattgtagttttgtaaccgactgatctaaataggaatagatgagacgtcgctggcacagttcactatgatagaagaaatatttcgcggttgatttgattactttaactatgaattccatacttcctctacactacaactatcaatgcttcttcttgttcttgctcttcttctcaatcctcctgagggctctctgttcattcttgagcacaccatcaaccatcttatactttcctttcacaccctttggtctaccactgactcctctattcttaccagtggctctaataagagtgacctttggtttcttgttctccttcttggataacctacgcatcagggcattgatttgctccgccttgtcgttttcagacttggcactatcgtcattaataagatcggacttctttctcatcttctcaaatcttctaagagctctcatcttctttcttcccttagcttccatgaccttcttgataggtctggcattcagttcacgcattttctctttgattgcgtctgaagcttctttggtaataggtttgacgatcttactatgttccttctcgtcatcaataaaccacgcggggagaccgttggtttggcggaacgagtatttgttgataccttcttctatcaaatctttcttggtcatgcgtcccaaagcaacttggtgggccaaagtcatggcttcaaccgtagccagatctacattcttttgattggccttagtcaagtttgtatcttcctcttcatcagaaatgtccatttcatcctcgttccattgactcttgggtggaacaatttcaaactctgactctgagctgccttcggcttcatccaactcttcgtcattttctgactcttcttcgacccgctgcaaactctgagtatgctggagtttcttagatgctgcttgttgttcctcctcttcatcagagtcaagtgcctgaaaaacagaatcactgaaaaaggactgagcagtggtactcaatccggtatcattattatgttcctctatttttctgttagcaatcaacgagtcaagcactctctccgtatcagagtcgaaatcactgtcatcatcggaataatcgtcatcagaacttttacgttcttcagcactgacgatcccttcccattcttcatcgtcaccttcagttttatcctttgcaagcagtcggggattcttctcaatctttttttgtagctcatgggcataacccatgttaagttcgttttccaaaaggtcaatttcggtctctgagtcaacttcctttgtctcttcaactattaccattggtttcggtttatccttctcagaatgaaaaaccatagctctttttccacttgctaaatcatcgagctttcccgttctttcagctatcttcaagttgaacaatgaagcagaatctgcctttactgcgtcaactccaatctgcatatctgtcaacatgttcatttgcattcttctgatgatatcttgtttctgttcgttcttctttcgtttctctctcttttgtttttgtctctcattttgtaccagctcatccaactccttggttatttgagcttcctcatccagtggctcgacatctactagagcgtcttctttctcttccactttgtccagctcaagcaacaaacgagccttctttctccatttcaataagtgtttgaaatctttcttacccaacactttcaaatctttacagcactccaagaattcctttgtggtttgctccatttttttaacttgcttccagtctgggtcttccttgtcaatagtaaattgattaagagttcctagaatgttgacaacgtcaacttcctgtttgacccagtccatcaaaggaagagtcttaaattgaaggtagtcttcttcttcataaccttctctctttctcacctttttatgagggttgaaaaccttggcctcattgttggctgcaccagactgaacttcctgaaagacctctttggggtctaataacctgggatcaattctctttggggccttgaatcctttacagactacaaaaatttcagcagacacattacgggatgctggaggcttggtcgcctcaactttatcaaatagttgttgaaagatccacatcaagttgttgtaatccttggatctgaaaatcttggtgacaaacgtaccacctactcccaaattctcaacagccaacttcagagcttgtaaggttaattgagattgagtaaatgcatcttgaacccatcccagacccacgttgggggcaccatcatgcaaaactgtgtccgccttccacgtcttcatgtgtcctctcaatttggaacggcagtcttcagttgtaatatcagattggaaagtcagacaatttggcaaaggtttgatttgaacaatatcaacaccgatgatcaaagcattgactggacaaacttgcgacgcaacctgacaccaagaacctggagcagcacataaatcaatcactactcttgacttttctaaaaaatgaccgtatttctcattgatttgtagtagcttgaaggaagaacgggcacgataccccttctcctttgcaaggtaatagtacctatccaaacgacctttactatttttcttctgagtctttgtacccatggtctagcttgcttaggtttacaagagaaatcaatttctaaaaaaaaaaatttcactccaaccatcacttgccagataaggtaataactcgccatactggccccttgatttggtgttagtcagactaaacaatttatgtagtgccttacccatcttacgcgttctcccagtgttggtgaatatcgccagtttccatctacaaacagtcctttcctcttcaccttttgtcaatcagagatgagccaaacagagagcactaagggtgttaagattaccaattacgccgccattaagaacgcccctcttccagcggatggaccaggtgctaagaacttctccaactggctcctgctcggtctgttgactggggttccactgtttgtcactcgcaaattccatggtggacttaagacttttattttctttttcattctctttgcaatcccaattctgatggcttattggactgtgttatcttcttattccccaagattgaatgagaaggttcaattcccaaataggggcgtcgaacactaccttaaatttcacgatgaccagttagctgctaggtaccagggtcaaaacaagattcctatggaaaccttccatgaactgtattttgaaggtaaggtttctttcaagggtgatgctttggatgctcttgaatacaggcatgattgggcatccttcagatttactctgtctctgtttcgtttcttcttgttgggaatgatccctgaagttatcatgcattcccgatcccaagatgaagaacaagttagagatcactatgaccgtggtgatgacttttactcctggttcttaggtgatagaatggtctacacctctggtttgatctctgatgtcaacaaagatgaatctctggaagaattgcaagacaataagcttaaaactgtttgtgaaaaaattcaattgaaggaaggagaatacttgcttgatctcggatgtggctggggaactttggctgcctttgcttcgtctcaatatggagccaaagtcactggaattacacttggtaagaaccaaacaaaatatggtaacgataaaatcgcttcttttggcgttgatgaaaagcaatctaggattctttgtcacgattatagagatactcctcttcctaaagatgaaaacggaaacacgactaaatatgacaagattacttgccttgagatggccgagcatgttggagttagaaaattccgttctttcttgcaacaagtttacgatatgttggacgatgatggtgtttttttcttgcaatacgccggattgagaaagtcgtggcaatacgaagacttgatctggggtctgttcatgaacaagtacatttttccaggtgctgatgcttctactccattagactttgtcgtttctgcactggaagctaccggttttgagactgtatccattgacaacattggcgtgcactactctgctactctttatagatggtacaaaaactggctgtccaacagagacaatgttgtcaacaaatatggtatcaaatggttcaagatttgggagtactttttagcttcttccactatcatctcgagacaaggttcagctacatgctatcaaatagttttgaggaagaacctcaactcttacgacagggctggttatatttccactcaggaaggtttacagggtccaatttctagaaagactgactgggttaaatagagtattttacattgaatatatctggatgtccgatgtagtgtggggtttctggtcgcgcgcacttcagacttatcaacccgcctgtgtgataagaccctagtaaaacccgtgaacgactctagtgaagtcaataggctggccaaatattctctagtctattggtttttcacaagcgaatactaaaatgcattcatccgaagatgacgtttcaaagaataccgctcctaaattgaaacctaaactgtctacgatcagtttaggtgtatcaactcagccgctatgttacgacgagagtcatgttccttcacagagattactagacgtcactctatccagcattgatacacgctctcctcggctatttgttgcaccggcagatctcgaagatggaggatattttgacgttgaagatgttcaacaaggcggatccttacgttcggtgtcacctcctaactttgatgcctacacaccaacgagaccaacaatgccacgctttctgactagtagcaggctgactgctggctttttgtcagggtttctgggcgctggaaagtctttgcacagtggagctgggagagagaatagtgtcaactactatgatgacttttccatttctgattcaatcaattctaccattgagctttcagctgagcaacacgaattggaaagaagggctgcgaagtctctgaaatggaaattgatcctcttctattacagtctacaagagtggattctaattgtcatcattgcattcctgagttctttgttggcatacgtgattaacaaatcagagtctctcctaattgacttaaaaaggggttattgttccgcaaatatattcaaaaataagcacgattgttgtcatattgctgaactaaagactgagactatcaattgttctgattacaaactttggtcagaattacttcacacttctaaattcattgtttcccctgagtttcttatcttcttactactcacattatcattagcctatatgtcagtcaaactaactttaaccaccaagacgcacaatcctttaccaaatccaagaaaatctaacgctgatgtcatttatactgcttatggctctggagtccctgaagtcaagactattctatctggcttcattataaggcgatttctgggaacatatactctctttttaaagtctgtcgccttagttttggcaatagcctcgggaatggcgatcgggaaggaaggtccatatgttcatttgtcaacttgtattgggaatatttgtgcaaggctttttactaagatcaacactaattccctattgaagcggcaaattttgagtgcttcagccagcgctggggttgccttagcatttggaagccctcttggagctgtgttatttactattgaggaagtcagctactatctgccagttgaccacctgtttcgcattttcttctgtgctataatgagcatccttttcttaaaatttttaaatccctaccaaaccggaagagctgtcctgtttgaagtttcgtatacgagtgactggcgaccttttgagctgttatgctttgtgattattggcacagctggtggcattcatggttcgcttttttgcaagttcacttcctggtggggtagaacctttcgaaatcatcgtctcataaaaaacttcccagctagagaagtaattctagtggcctttttgactggcattttaacattttcaaactctgctaccaatcggtcaacaacagagctacttactgacctagccactccatgcgaacagggttccagctgtccctcatttgacaatcaattaatggttgacggaaagcgtggagtcttagactatgtgaagctgaaacaagaattcggagtcttgttcggtgcgctgtggataaaattgatattgactgccgtaacttttggaatcaaagttccatcaggtatttatgtcccctctatggtgctcggtgccttgtttggaaggctcctagctatgtttttgcagatactgtgcgttaaatatccctcattaagtcttcttttgtttgatcggactttcaaaactattggcgaggtcgaaacttgtgtagactttggtatctatgcaatgatcggagcaggctcttttatggctggaattaccagaatgaacgtgacgctagcaaccattctgtttgaactgacatcttcatacacatatgttcttcccatttccatctcaattgcagtttcaaactgggtagcatctctcattgaaaaaaaatctttgtacgagctattgatatggaaaaatgattacccctttttagacaacagaagagttccatcatttgacccgaaaatgaccttaaaggatttgttattcttgcatgagaggaaagacacgtccttaatcaatggctctacaattgacattgtggagtctggattcattaaagccaacgatttgagacggcagatgaacatactacgatcaaagtctttgatcgacggttgttttaccattgtcaaaaattccagtattttagtaggggtcttaccgttgaacaagctggaactacagcttgacaagattgatcagttcaagtttgaattttcaatcgaaaatgacctgcttgtgaagctttcagactccaaagacttcggtgatgccaaacttaattcagattcggtttcgaacactctctctaaaaacgatatatattcaaaaactcattcttcaaatctttatgatgatcttgaagatccttcaaaattagagcagtgttcgaaagaggagatagttattcggttaatgagttcattgaccgatttcacgagaataattgaccaccatcctcttatgctggaggcgtcttcaccattatccctggtacatatggtattctccaggttaggaaacagggagatttgtgtacttgacaaaggtgtctttattggaactttgcacaaaaagttttttattgattatttaaagaatgaagataaacctaacaattagtttacttatgatcatgggttcttatggatttggctttttcaatgcagtagagactagtcacaagcgtctcaaataattgcatgttttgtcttaatactgaaatgtcaacaacttcattagattcaatgaattctatcaaacattcttgtgtctgtgatagagttttgttattggattgcaggagtaactgttggatagattcactgggtttaatatatttaaaagacccaccttttttggatatgatctctctatacaattgaaaacagttgtaattttccactattatcctgctaataataccaatagtattttcaaatccctctttactggttacttctttaattggtggaatggcacatccagtgtcgaaagaatctacgagtcgattcaacaaaactaacaaacctgatgaaaagaagcaagtgatagggtcattataaaaataacttacttgtgtggacaacaggtaaaatgacaaagatttggacgaatcaaattctaaacgctgatttttatttacatcatttcctttggagttgtcagcagccagtttgttttgagatatcaaattttgcactatctgtcttgctacctgatcggtatcaactatgcaactcttggaaccagttatggcataacacattgaccgcaaaatctcattttctttggctggctccaattgagggtgacatacttctttgcataactgagaaggttctttgagaaataggactgctagtgtttggtccagaccaaagttgaataattgatacactaatttgaaaacaaacacttggctattcgtgagtttgttccaatgattaatgtcttctatcatgtccttatttggatccctgtttaggcaatgaagaaacatcttttccaaagatgtttcatttattaagggagttaggaactcttcttgaagcatttcatgttcgattgaaaatattttgacaaattcactcagaagatatacagtgtaatagcaaattgagcaattaatgtcttctcggataaaaaatgcatttatcaagtctaatatgttacggcggatttctttgaaaatgttgattctaatatctcttgcttgacagtcaatcatgagttttaaaattttgcagagccacctttcaagcaggcgaatattgaatagtaaactaggattgactgcagttgtctcttcttctttgatgtgctggaataagactttgatgtttacatcaatatcactaattggcgttccatccatcattcgaagtaaaggaaactgatacttgtacagaatcggttcaaatttgggagcctggatcaacatcgcaaccgaaatatcctcaaaaggctttacaatgaacctcacaagcttgccggattgctttacccagttttcaacttgaattgaattattagcgcacttgattatattttggaagcaatcatagaaaattccaaattcatccggaaactgatgtgatgtgggagcaaacgagaccctttgaatggcttcaaataaaggaaatagtttcgtttcgaagtaagaagaaggccaaatcttctcatccttcagacttgcgttttgtctgtcaaggctcatccaatggctaggaacatttggaaataactgaaagaactcggaggtttgcagaagaaacgacaaaaggtatctatgaatagctacggtaccaaaggaatcatttgttgatattgctacaaggaagatgttcagactctctgacactaaacacttttcagattccgtgaagagtgggtctttgaaagttcgactttgacaaagggtaaactcacaataacagtacgtcgtttgcactatttgaaacaacctcaattgttctgttgtcacttcttcttcctcgggggtgcgatatagctgtagtttggccacattgtgcagtacctcttggttcaatagataggcaagagaattttttgcattataatactccctgtcaatttttttacatgcctctaaagacaacgtgtcagttggctcacagttcttgaacatgggatctaaagtttcagaaacctgtttcagactggaaaccaactctgtttcaagtgcatggctgttactacccaaaggctaagagttgttaataccaatgttcctaagttcgctgcgtgatgttaacctacctgaaaaacgaggctgctaacggttttattaatttgttcccccaggtatattaagtaattatcggaaatcatggtttcggtaaacttgtcaatacatattgtccctatcttgcctcatagatttcgtttcagaaacacaaaatctgaagcgcatctccaaatctggtacctgcatattctattgttcgagaagattatatcatatgattgttgcgtatcatgttagaaactactttacaatcgaattcggctcgagaaaagcctaaatatgcctggtagtcctgatacttcctgatacaagcctcaaacggagataggtcctatttaagtaagaaaaatacctattaagttgcttccacaaccttatcacagtaatgagtaaagttgaagtggctcatccgacagaaaaaagaactactactaacagcaactcaaacaaggtgtcaattctattgaggaacaagttcaaacaaaagtatctagcgatgaactcggcctttccaaatcactacagccacccttcaaagaagagtaaacagaagttcatagtaaacaaaagctccaaggattacttcaagaatgaccacactaatcagttcatccatacaggaaaacggccaatcgaaaatattcgaaatattgagaatccggtaagcggatacccaaaactgcagcgtttgctgtccttaaaacaagaccaaatcaacaaatatcgatccaaaccttttggtgcccgagtacccactgagaaaatggtagaaacaatagatagatgggtctcaaagcagaaactaacttttgatgtcattatgatcggtggattgtcagaaaaccagttcatatacccgctattgctcaatttgcaactagacaagttgtgctccaaaccaggttttctattcttttgggcttccactcaacaagtccagcagctaactagacttcttgaaagttcttcttggggtggaaaatttagaaggtcagaagagctggtctttttgcctgtaggtagagattcgaagtatataccagacaaaaatgacatacctgaggaaagcttgttgcagcagaagcaatggcattgttggatgtgtatcactggcactgttagaagatctacagatagtcatctgattcattgtaatgtcaatactgacattatagtggaaaacaccctaatgacctccagttgcaataatattgttcccatttcgatgtatgaactagtggaaaacttctcatcctctacaagacgattgcatattctaccagcatcggttggactagaacattcgttgaaattacgtcctggttgggttatagtgggccctgatgtcttggtagacaactttgatccatccgtctacaaacaggagatttcctctgttggtagcaacgttccgtccacagatgagatcgaccttctccggcccaagtcaccaaacagaagactttcctattgttagaaagctcaataccaaaataaaataatgctatcatctaatttacattataccccactaaataaaagctacttaaaaaaaagagggatatcgctacaacatccgccttcaacaaaaagcctaaaccctgaccttaaaataataaaacatcgacactagagagtttgaaactcaaaaatgtaattaagaaatgaatatcttgcctttaatgaacaagataaaaaaaggaaacaaatggtcgtaatgtacagttgaaagggccactaaaaagatccttcaaaacgaccagcctcaagttcttcgatgatagtatctccaacgacatcgtcattgtcgtcatcctctaccaattcgatagtggaatacttgataagatcccatcttttccagaaactaagactgtcgtcaatattgtttgattccacaaaatcttgaagatgatactttgacttgatcaatttatccttcaagtcttgcagtctcaagttagagggtttttcggatattctgttgttatcactttcataatcagtgatgtccgtcaaatcaccgttatcctcgtcattgttctcagcttccacatcctcttcgtcagaagaaaatatagagttaggagtgttgggcagtatctgctgtgcagaattagtgctcaaacttcgagttcgctgatgctgttggtggtgtgatgacttggaaaatccatatacttgatcttctgtgttagaagttgcatcacaatatctagcccaagcttcatcaatagcaccaatcaaatagtcaaaacacctagatctagcggtgacatcagactctgggacgcagtgtctagatctagaactgtggccgctagaagttgataaaaagctaagatcggtaagctttggcggagatgtattgaaggacgctcttttcatcctattgagagatgaaatgtcagagtttggattttcccgttcattggttaacagagagaaactgtgtttattggtagcacgatgcccaattggtttggacaccataacattgctatcatcatcctcttcgtcgtaatcatcttcttggctgtattttgcaaatgcaggagagagtgataaatccatagaaccaagacggaaaactcctgctttgggtctaggacaatcatcgtcctcctcgtcttcagcttcggacgacgacgattcaacaggcaagctactcaaacgttttttcataggtttggactgacataccggagacgatagctgcgctaaggaaatagacgcagagcgaccataattcgtgttaggacagagtttctttctgattgaagaatcagaagtagtggaagatctcttgagagacagtgccatgtttagatagtagtgcgtcgacaaataaaaaaaatcgtgaagcaaccaaaaaaaactgggtggcaaaaaaactgaccaatcagagtggaggaaaagacctgagcagcacaattaagtggtcagaagtgtttaaagtcgcctgaaaaggagaggtaaaagggtatcgaaataagtgtgaagacctagttcaaaaacctaacctgttagtgtaaacttttgaagaatacagtcacaaacaaacagcaagtacaaatgtgttgctgtaaattttatgggagcgaattggctttcaaacaacagaagaagaaaaccaatggaaaaagtggcaattttattcaacggacactttggctgtagagagtgcgcgaaccaacgttcgagaaacggtatgattggttggtttcaaaatttgctaggtacgttatcgtggttacaaggcttacgtggcactaaagtgaaagcgtggattactattggagtgaggttattgtatggcagtttagggcggtccaacagttggatttgacggtctcggctgctctggtctgtggtaagctggcttcttggcaagagtgttgcttgccacagcgcagaactgatagttactcaagcttgctatttttacacagcaaacttgtttccttttctcatctgacttccagccaggttaagtccgatgaagtacacaaatagggaaagcatatgcaaatacaacatacgcagcaaggagtcgagattgggtggggccaggtaaaggaaggaaaaactccttccccctacaaagattggcaaataatcgtactgcaatgcaattattccgaaactaagtccatcgcatacagcacccgcatacagcatcgctcatactttcacctaggtatgtgttggcatcgatgtggtcttcgctgaatcctcgtaatcagaagtcttccatagcctcgtaatagttttgggcttagtgaggaaattcagccctgcctgcccgtagaagttcaaatctcctaggaaggaacccctgctgccagtgaatgagaacataggtaatggcacagggataggtacattaaccccaatctggccaacatcaacgttcttggtgaacttttgttgcgcaggacccgacgtcgtgaagactgacgtcccattgccataagggcacttgttgataatctcaatagcctcatccaaggtttgtacgttgatgactgacaaaaccggagcaaatatctcctctacgtaacaatccatatcgggcttgacatttgctagaattgtaggtgccaaaaaatttcctttagaatactgctcaggatgttttcctcttccatccagtagaatttttgctccttgcttaattgacttttcaatgatcttctctgctctctctttagcatttggggttaccaatggacctagatcagaactggggtcaaatccacttccaatcttcaaccctttggcataatctactacgtcctgaacccagtttttcgtctctccaacacagatgaggacagaaattgccatacatctttgtccagccgctccgaaggcagctccgtttatagcattaacgaattgtgatctattcgcatctgggagaaccactaaatgattcttggctcctaaattagcctggcacctctttccatgcttagtagcttcttgatagatatactcaccggctttgttactcccaacaaaagtcacagctttcactctgggatctcttataagcttgttcaccgttgggacttttccgtggacaatgttgactactccaggagggattccagctttctctactagctcagcaataatcaatgcagccccaggcgcccgttctgatggcttgatgaccgttgtattgcctgtcactatagccaggggtagggtccataaaggaatcatagcagggaaattaaaagggcatattgatgcaatcactcccaatggctctcttgccattgaagtctccatatcagcactaacttccaagaaggaccccttcaagtctgacgtgatagagcacgcttgctctgccacctgtagtcctctcaaaacgtcaccttgtgcatcagcaaagactttaccttgctccaatactatgacggaggcaattctgtcaaaattctctctcagcaattcaaccaacttgaaagcaaattgctgtctcttgatgatggagacttttttccaagattgaaatgcaatgtgggacgactcaattgcttcttccagctcctcttcggttgattgaggaacttttgaaaccacaaaattggtcgttgggtcatgtacatcaaaccattctgtagatttagattcgacgaaagcgttgttgatgaaggaaaaggttggatacggtttgtcggtctctttggtatggccggtggggtatgcaattgcagtagaagataattggacagccattgttgaaggtagagaaaaggtcagggaacttgggggttatttataccattttaccccacaaataacaactgaaaagtacccattccatagtgagaggtaaccgacggaaaaagacgggcccatgttctgggaccaatagaactgtgtaatccattgggactaatcaacagacgattggcaatataatgaaatagttcgttgaaaagccacgtcagctgtcttttcattaactttggtcggacacaacattttctactgttgtatctgtcctactttgcttatcatctgccacagggcaagtggatttccttctcgcgcggctgggtgaaaacggttaacgtgaaatgaaattagacacacaacaaatctctcatctcctctcacgtcaaatgtatcatttagctccacggaagaagctcctgatttggggtggcagtctgggatttgtactacttctgctcatagtggcatcatctcaccagaggatcagatccacaattctccatcgaacgccaatttcaactttgcctgtcatttcccaagaagttatcactgcggattatcatccaacactattgaccgggttcataccgacagactccgatgatagtgattgtgctgatttcagtccaagcggtgtgatttactcgactgacaagctcgtgctgcacgattctctgaaagatatcagagattctcttttgaaaacacaatacaaagacctcgtaactcttgaagatgaggaaaaaatgaatatagacgatattttaaaacgttggtatactctctctggttcaagtgtttggattcccggaatgaaagcgcatttggttgtttccagagttatgtatttaggaaccaatggtagaagtgacccattagtatcgtttgttagagtacaattatttgacccagattttaatgagttgaaggacatagcgctcaagttttctgataagccagatggaacggtcatattcccatatattctgcctgtagatataccgagagaaggaagtcgatggttaggtcctgaagatgcaaagattgctgtaaatccagaaacgccagatgatccaatagtgatattcaatatgcaaaacagtgtgaacagagccatgtacggattttaccctttcagacctgaaaacaaacaagtcttgttttctataaaagatgaagagccaagaaagaaggagaagaactggactccgttttttgtccctggctcaccaactaccgttaacttcgtatatgacctacagaagttaacaattctaaagtgctccatcataaccggaatctgtgaaaaagaatttgttagtggagacgatgggcagaatcatggtatcggaatatttagaggtggatcaaaccttgtcccctttcctaccagctttactgataaagatgtttgggtgggcttccctaaaacacacatggaaagctgtggatgcagcagtcatatttacaggccttacttaatggttttagtgaggaaaggagatttctactacaaggcgttcgtcagtacaccgctagattttggaatcgacgttcgatcgtgggaaagtgcagagagcactagttgccaaacagccaagaacgtgctagcagtcaactccatctctaattgggatttactagacgatggtctggacaaagattatatgacaatcactctcagcgaggcagacgttgtcaactcagtattgagagtccgtggtatcgccaagtttgtagacaacctcacaatggacgatggatccacaaccctttccacttcaaacaagattgatgaatgtgcaactactggctccaaacaatactgtcaaaggtatggtgagcttcactaagccttgggggacttcaagtctttgctagaaactagatgaggtcaggccctcttatggttgtgtcccaattgggcaatttcactcacctaaaaagcatgacaattatttagcgaaataggtagtatattttccctcatctcccaagcagtttcgtttttgcatccatatctctcaaatgagcagctacgactcattagaaccagagtcaagtaggggtgagctcagtcatcagccttcgtttctaaaacgattgagttcttttgttgctacaggaagcgccctagggaactttcgcactttggaaatagattttgatgaccaagagcgggagttgatattagagaggctgtccaaagtacatgggatcaggccggccaaattgattggtgtgactaaaccattgtgtacttggacactctattacaaaagcgaagatgatttgaagtattacaagtcccgaagtgttagaggattctatcgagcccagaatgaaatcatcaaccgttatcagcagattgataaactcttggaaagcggtatcccattttcattattgaagaactacgataatgaagatgtgagagacggcgaccctctgaacgtagacgaagaaacaaatctacttttggggtacaatagagaaagtgaatcaagggaggtatttgtggccataatactcaactctatcattaatgtggttcttttggtagcaaaaatctttgttgttttgttcagttcctcactctcattgatggcttcgttagttgactccgtgatggatttcttatctactttgatcatatatgtttctaactcttttgctgggaaaagagacaagaatgagtatccagttggaaggtcaaggttggagcccttaggagttcttgtcttttccgtaatcataattgtctctttcatccaggtcggaaatgaatctttgaaaaagctaatcagtggcgaccgtgatgttgtttctttagataaaaccactatcagcgtcatggtattcaccgtagctgcaaagctattcgcctacttttggtgcaaaagctccaagaactcctctgttgttgcattggtggaagatgccaaaactgacattgtcttcaacttggtatctttagtctttcctgctttgggccattggctgggtatttggtggcttgaccccctaggtgctctgttattatgtgtatacgtgatagctctatgggcgtccattgcatttgtccatatcaacaatttaactggatcagcagccactaaaatcgatatgcaaacaataatatacctgattcttcgattttcagaatcgattaccaaaatcaccagtctgaaggcatatcacgttggggaccacatcaatgttgaagtcgacgtgatatgcaactccaagttagacttcaaggagttccatgatctggccgaatcaattcaatacacgatagaactgttaccctatgtcgaaagagcattcgtccatttagactatagactgggaaactacgtaggacatctacactagaaatatgtaaattataatccttgaattttgcttacaatgttcagcgataataataattgtcaccgaatcttcgcttacgtcgctacttggcacggcactactatattgtctctccaatctcattcctcccataacggtgaagaaggcaaatacataccaaccctattagatggatccatcacaggaacagagggaatggcaagaacaatcaattgcgaatccccaacctcagagtgggacaatcatcgaggattttgtgtttgctgtaggaattatcaactttcatcacatcagaggacctgagattgagtattggttggatgcagagggcaagtcgccgttagacacggaaaagattgctagcataaatgaaagatggccgtatttatcctttgaagcactacctgatggagctcatatgttcactgaatgcttttctgagttttctctagtttttgaccaatcgtcattatttggctgcgcctgtgtccgacaggttgacagggcagatttgctcaataatgaagacaaagaatacacgaggagtacagtacaaaaggctgttgttttaataacccgataccccattacaatccaattaagggagcagctaagcattatcaccatgacgttctttgagcagatggattttagagatagagagatagtgcaaatgttttatgataatataagaacaaggtataagcatgttaagatattgaacgatgatccctatgaaaccctaacagaaaatagtagcaatgaaaatggcgacggcgctttgaagattataaaggagtctgacttttatgttggactggatctgaagcatttagttttgggcttgaagcgaaacttgctgatacttttgaaagcattactattagagaaacgtatcatgttttacagcaaaaacttgatgaagctgttcaattcccaaatgtctttcttatcattaatacctaatttattactaaatttgcaggattgttccgatccttcattgaacagtctctctcaaaacagaaagaagctcacatcgttgaaaactagtgacagaacttctttgctaaacttcattggattgcctctcaaattgtttgataaaggtggattctttcaaccatacctcacacttcagcaaaatgaagtgctgaacaaaaagaccacattatggtaccttgtaggcacctcaaatgatttatttttaaatcaaaaacacaaaattgcagacattgttgttcatgttgatcatttaggagaatcatcaattgagatcctcaatgaagatctcaaaccatcactttcattaaccaacgcagataaaaaattcattgacttcattgtccaccaagttaagcttgcccatttagaaaatgaaggttcaggcagcaatacaataaacaatttcaacctttcccgatcattcaacgggggtaacgagttcatcagaaacaatcttgaagattacttaatcggacttttatccacattgaagtatgaaaaattccttgaaaatgccactccgacccaactgaattcattgattcccataggaaatacgaatcacaaccagttgcacagtgacgtcaaacattataacgaacttttcatttcagagtatcgaaaatcgaacaactaccaaattttcgacgatagcacggatgacgaacttttcaatttttttgagccgacccatgcagctaatctcattgcatcacccaacatatgggataagatggcaaaaccattccagaagttaaggcggtaggttatgtagttttggcaagtcccaacagtaattaatagacgtttcctatcgcgattataaaatctcctgtattgtcccttgcttccactctcttagtttggcatacgtatcaatgagcaaaaagctaatagtttttggagggaatggctttctaggtaagtcaattcaatgctatttattcaattaaccttgctaacagttttttcaaggaaaaaggatatgccaggagggaatcaaggctggttttaaagtggtttcattatcgtaagtacttcacattttcttcctctaagtcaagttcttctaacaataaaaaaagctcttctggaaaatccccaacaaagatcttaccttctgatgatgagtgggtcaaaaaagttcaatggaaaaaagcagatgttttcaaaccagaatcctacaaagatatccttaaagatgccaatgcggtagttcattcagtcggaattttgcttgaaaacgctgaatataagaaagccatcaattcaaacaacgatctactgggagagatcatgagtttctttcaaacctctaacccaatgaccaagaacgtttccaattcttatgacgcagtcaatagggaatccgctgtcctattggcccagactcttattgaaagtaaaggaaaattacccaaaagcatttctaaggcaccggcattcgtctatatatctgcagatcagcagcctccatttattccgtcaggatacttagagtcaaaaagaaaagctgaatttgaactatatcaacttcaacctggaattagaccagttctcatgagaccctcgttcatgttcgatgaacatatctcaggagacgttagaagcaaactgaaagatttgataaaactcggtgaccagtttaaccaaaaaatactcaacaacgccttaaaagatatcataagacctacagtatctaccaatcaagttgcaaaaagtgtcattgaaaagatcaacgacccagaataccatggaccagttttgcttgaagaaatagtctaatatattagcgtatacaatcacctcttgaactttttcaaaggattaactcttttcctcacgcctcctcttgggcctctcttctcatgcttatttgggtttgtattcttgaaaggcacaaatccaaccgttgggtgagatctggctcccttcgggagcaggtaatcgggaactctcttcaaatgaggttgaactctatttggatgcagttctttatcatgcctcaaagatagtaagtcttgtgggttctcttcaaaatgtctctgtaacttttcattgaccatgatttcttgcttgatctccttgattctagcattcctaatagctgtggcggtgacggctctgaatgcatcttccatacggtatctgaaaccttctacctgggactcgttgaaatgataaggttccagtttggagcctattctaccttgagccgtcattattctggccagaatcttttcatctctcttggcactttttaagttggaagcaatgtgtttattccataacctcttttcgacaacaaatgagagtgccataccagactttcctgctcttgccgttcttccaactctatgaacatatgacttggctgttgttggaagatcgaaattcagcacgcaggctacatttttaaaatccacacctctggaaaaacctgaatccctttgcttggagcttttactgttgattttttcttcctcttctatctcctcctctccgtcttcattctcttcagttttctctgtattattctcggtagatttcttttcagctactttttcatcagcattcgtttcagtttcatttgcttcttccaaaaaatcttcttccctttcttctcccacgctactctcatcagttgcaattaataaccgatagacattcttgttgaattgatccacagtatgcattcttgaactcaacggaagttcgttgtttagcaaacatgacttgataccaaactgttccagaaagagtttcaatcggtatcctctatcaatgttattgacaaagatcaaggtcttacctttgatcaggttcaatttaaatatgacataactcagcaaaaatttttccagttcaccggttttgcaatagtactgaactaaattggaactttttatcgcatcgtcgtttagttttaacacagcaggtgccttacaatacaaagctttcagctgttcaacgtcttcattcatagtagcactcatcaagaacacctgaattttattttgtaagttcaaatagagctcagttagttccttcaaatcatcgtcatatccataggaaaagataaggtccacttcatcgatgacaaaatatttgagctggctcaggtttacttttgaacttttcttcaagagttgcaataacttggttggagtagatatgacaatttcaggaagttctgacaactgtgctagatggatctgttcactgacactattagacagattcaaacacttaacctttttgctgcagaaacttgtaagactgtccaaaaacttgtcaacctgaacagatagttctcttgtgggcaccaagataacagcttgaataccgggcgttctattattgttgcttaaaatactttgcaaaataggaatgcagtaagcagctgttttccccgttcctgtacttgcctttgcaatgacatctcgtttctcttgcaaagctaaaggaatagctttagcctgaactaatgtcggatgctcataacccagctcgttaatggcctgtaaaattctaggatcaaggccaaacgagtcaaaagttgttgagttatccacataagcttctgctgctgcttctaatctagccattgatggagtatatgtgtattgagagaagcggatagggcaaaaaaattttagaattattttttttctttagcgaaataaggagatgaggattcagatagaagcgaacggatcctagatatcacagtaatattatgatcagttatatacaggtacagaggccaaaaagtgatctactgatccactttttcagacgtagcttcaacttctttttcttcctcaaacatgtgctcttggatagtccatagctcactgtagagagaccctggttgttgtagtaactcttgatgggttccttcttcgattacatggccctctttcaacacaataatcttgtcagcatcagcaattgttctcagacgatgagcaattgaaacattagtgttagagttttgtttaaacacttcttttattgtcttcaatagggcctgttcagtatgagtatccaaggctgatgttgcttcatcgaaaaaagttatcttagaatttttcaataacagtcttgaaatggcaagtctttgcttttcaccacccgaaatcatcatacccctttcacccactatagtgttcgaaccgttgggtagatcttggatcaacttgtccaatttgacctggctgatgacatttctcacctcatcgtctgtagccgacaaccttccaaatcgaacattctcccagatcgtatcattgaataatggagtgtcttgaggaacaaccccgatatgttttcgtaagctttccacgttcacttctttgatgttctgtccatctatgtaaatttttccctcagtgacgtcataaaatcggaataccagcctcaatatagtggattttcctgatcctgaaggacccacaatggctaccttgtgaccagcaggaatagtaaacgaacagttcttcaagattggcctgtcagggtggtatccgaaagaaacattctcaaatcggatttctccacctttcacaagcaagtctggggcaccaggaagagatttaatctcaacctcctccttttgtagcttgaaaagagactccatgtctagcaaagactgtttcaactccctgtagacagagcccagaaagttcaacggaacggaaagttgaaatactaattgattgataaggaccaggtcacctacagtcaaatatccctgggatactcccacacatcccataaacatcatagctgtcaaagaagaggtaaagataagattttggcccgagttcaagtatgccaaggacgtcgctatcttaatttgagcatccttgtattttgtcaaagctgcatcatatttcattgactgaaacgactcattgttgaaatacttgatcgattcaaaattgatcagagaatcaagagccactgatgcagcttgattgtcagcattgttcgcctgtctcctaaaaccggttctccaagttgttgttcggattgtgaatatagaatacgcaatcatggtagctagggttacagctgcaaaagacattccataattgtaagttagaataccacaaacaaccgaaatttcaaaagttatagggataatatggaataccatggcacttagcacgtaagcgataccttttgtaccacggtcaatggcacgagtcaacccaccagtttggcgagtaagatggaaattcagatccatatgcaacaaatgtacaaaagtattatgagccactttcataatggcgctctgagcaactctagcaaatattgcgtttcgaagttcaccaaagagcacagcgccaaatcgggcaccaccataagcaatgatcagtgctccaataactgaagtcaccgttcctacgttttgttcccaatcgatattcatattatccacaattgatttgaagaaaaaaggaacctgaacattgagtagcttagcagctaccaacaatgacaatgcaataacaacacgaactttggcagcaaggttatccttgggccacaagtaggccattaaatccttgataattttcaattgcgaaagctgcggaagtttcctatccggcttggaagccttgtgactgctgaaccgtagttgaggttgataaactggtttcaaggcagacttgtatgtgattgcactggcatttctaaatcctgagtgaaataccgattgatacctaaaagaaatagcgggtcgaaacttaaaggaaggcggtaacctaatgggtgtcctcattatagacgagaacgatggcaaaccattgcaggacaaccttgttctcatcttttgtttgggaggagagataccgagtgtctgactttcaagtgacagttgggtctgatgtacaatattcacgtgatcagaaacaaggaggtggagagaatgaaaaataaaaagaagcccaacgcggggcttgaacccgcaaccttgtgattaagagtcacacgctctaccgattgagctagccaggctgttttatttctaggaattaaggagataaccttaaagttaactcaagaaacactctaaaacgagtggtggattatcattaccagttagcttagtgttcgccatattatagacctagcgattgtttaatagattgaagcacattccaacaggatgaaattcagaggacttacgggtaatgtgcacctgaaatgagaacttttgtaagaatgtcaacttaatttgtgatagatactcgtatgtctaaatcagctaactagaatgaaattaacaaacttgggtcattatcttagaaatgctacattcaagtgatacggaagtataacggtagaaaaataaaaatcggatttgatcctcgagtgcattgtatgtgtggttgagttcaatatctctcaaatatagcatagacagtaaggtcagtattgacgcaaatattgaagctgacagcttggtgtctatctttgggtgaattaacattacatccttcactgtgaattaacaatacctgtcctgcgacaccaacaatcgtctatctcgttctcgtattgaatgtaaactttgtcgaaagcaggattattcgtaagaagtgcttgaactttttgtttgatggataatgaattctcagttctataatattgaatatgaatgtagcctgtgagggtatccttgggaccatttccattgagaggccaaaatcttggtgttgagtaagattttacagcatggatcgaagataatgccgataagaaatccttaatcgcctgatcatgattaccagtgaccgagaggagcaaattcttgctcgaagacttcaataatggtaaggaactaacaaaaatcaaagatgcaatagtcaacgacattataggatccaggatttgaatgttaagccatttaatcaacaaggtggaaataacaaccccaacagatcccagggtatcagcaagaatgtgaagaaaaataccacgcatgttgtcattgtcagcaactgtgtgttgtggatggtctggagttttgtgttcatcgtggtcatcttcacacttggaatgcgagtggtcatgagcatgggtattattattttcatgtgaatggctatgatcgtggctatgactatgtccgtgactatgtccgtggctgtgtccgtgatcaaacgaatagatcccgactaggtttaccacaagtcctaaaaagctgacaattagtagttcatttgttttttgaaggtcaactggatggaaaatacggtgaattccttcactgaaaatcccaaagactatccccagcaataaacttgcatttgtaaaacctgctaaagtttcaatccttgcaagtccaaaaggataaaggtttgcagaatcatagaattgaatactattcagttgagcctttttgacttcatattcttgcctcggtaaatgtccatacctttttttgagtttacgttcacgctcttctcggagagccttagaagctttttgtctttcaaggtcttcggcagcaaaaaagttggcaagcagccccaaaagtaatgatgtgcagtccaatagcatgtgcaaagaatcgctcaacaaacttagagatttggaacggaaggaatacaacaattgtaccaacatgaatgaggtgttcagaagaagaaagttgaaaatggagcttgacttttgagacttgagtaaacgactaatgaatgagggtttcgcagctgagctgcggggctcttttggatgcaaagacttgttaaagtttgcttcatcaatggcgtcttccagcgacaatggtttcaaaaatatcatgacgaaaccgttaagtgacaactcaaacaggtattccaggaagtgcttcggaatgctgagaaatgacaccaccatgcaaattagactgagaatcaagagatgagccttaggattggtcaagaatgctgaacggtcgaacgcttgaaaaggtgattgcaaacgtgattctgtctgagaaacggttaatagtactaatgatcccacagcaatgaacaacatttgaaaattgatactatcaagtccccaccaaagtagcagagcaaaactgacagctgatatcaaaacatgtctcaacttgccttcggaaccagcaaggcttaatccgttacgattgaaatgtaagaaaatccaataagggatcaatagactgagataggaaatcaccaattttggaaacacatctttgtcatgatttcttgccacgtcgtaaataaagtaaatccctgcaaaaaacaacgattgaaatttcagcagctttgaatcgtactttgcatcaatccttgtgcatatcaacgtgatgatcaccaagctaatggttctccctactggcaggtaaccgtttgcgaaaaacagaattgtcaacgataaatacactaaaaaatcattccccttcttctgtggttcatcagtcatctctctagttgcccagctattccaaaatgtcaaagctgtagggatcaagctgctgagaaacacactctgaagaaaacagagcatagggtctttttgaatcgaacccagcagtctgaacgaaattgccagcgttggaagtgctaaatataaaggagcaaggtccaagatgctgaaattttttccgttcattatatctatgagctattaatcacccaattaaggatgatactggtataatgtaaggctagacaccattgcatgcaccgagaacgagaatagacaccttgggggttggttcgcgaaatgttccttcctgtggtttacttctattaagggtgtagtgtacgctatattttacatgtgttcagcatgtcaatcttaatttgaggagtagaggtctttactcttttgtagatgtatttgtctttgtagcctgaaaccaaatcaggaatggaatcacaatctgcaacgactatgaggtccatattctcgatgtagttaatgatcgaggttggaggtggctccttattgagccaaatcacacaacctttacagcttttcaccgctttcgcaaactcctttaccattcttttgactccagggattttcaatgatgtgcctgctactatcaggcagtcaggtcttgatttcaagtccatttcgctaatggctccgatagcttctccatcaggatgatgttcgttgtagagaataatctttggtttgagaattccgtgtcctaacgtccgtttaccaactagttctctcacattgtccagttctatgcattcagggcaggacatttttgcagagaaatttggtcccaggggataattaatgtgacatttagtgcatgaaacctgttttatgttcccatgtagttgaataacattggggaatggagccttactaggcaaaggagacttggtctccagatagggacattgcaattccaaacagtcaatgttttgagtgtatactcttaataggtttgatgtttttgctagttcgttaatgaaatggtgaaatttactgggtttgcttcgttcaaccaaacttgacagatccctaatcatgctggtaaattgttgaatcttatcagaagatcgaaataagtttatgtcgaaaagatcctttcccgaggatccgccgtatttgctaaatattcccttggaagatcgaaagtctggaattcctgaagcaactgatacaccagctccattgactacaatgatccgttgagaattgatcaatgcatgatataggaaccctactttctctggttcatctgagagcgtctgggtgacgtcgtgaacttctaggattgtatttttctctggtctgtatttcaatggcacccttttcagccgttttcttctggttggtgtgctctctgtacttgcaggtaatgtttcaggaaactttttcctaatactctgaggagttggaggaagatacgtctctgaatcagaaatcaacactgaatcctgtctttccctcttcataccaacggcaattgactcatgttcagcagtcttgcccatggccaacttggttaagtaaagatggattatgcccaattaggaaattttaatttagctattgcctacttttttttcttgggtgcaccgcgaggagtgcgcaccggtctgtccccccaacaccaccttacgagcttcatggaaaaaactaaacattaccaatcctcctacaagtctccaattcatcacatctaagagatcatggttcaaatatccgaggtcaaagagtcgggaagcagagagtccagaactgccgcgcatacccacattaacggtctagggttggacgaatacggagctgccaagaaagttgatggtggttttgtaggccaagctgaagctagagaagcttgtggtgttattgtggaccttatcaagtaccgcaagatgagcggaaaggctattctacttgcaggtggccccggtactggtaagacagctttggcattagccgtctcacaggaactaggccctaaggttccattctgccctattgtaggaagtgaacttttctcagcggaagtgaaaaagacagaagcattgatggagaacttcagacgagccattggtttgagaatcaaagagattaaagaagtatatgagggcgaagtcacggaattaacgcccgaagaaagtgaaaatccactaggaggttacggtaagacgatctcccatgtcatcgtgggtcttaagagtgcaaagggaaccaagcagcttagattggatccaagtatctacgaagctattcaaaaggaacgtgtgtctgtaggagatgtcatttatattgaggctaatactggtggtatcaaaagagttggacgttcggatgcttacgctaccgagtttgacttggaagctgaagaatacgtaccactacccaagggcgacgttcacaagaaaaaagagatcgtacaagatgtcaccttacacgatttggacatggccaatgccaaaccccagggtggacaagatgtactctctatgatgggccaactactgaagccccgtaagacagagatcactgataaactacgtcaagaagtcaacaaagttgtttccaaatacattagtcaaggtattgccgaactggttccaggtgtgttattcattgatgaagtgaacatgttagatattgaatgcttcacttatttgaatcgtgccttggaaagtaagatagctcccatagtgattctagcttccaacagaggaaagaccactgtgcgaggcaccgacgacgtcaaggcacctcatgggattccaccagaccttgttgacagattattgattgtacgaactttaccttacaacaaagaggaaatacaaactattatattcaaaagggccaagatagagggattgaatatcaatgagcaggctctggatcgtgttgctactatcggaagcgaaaagtctctgcgttacggcttacagttattgacaccagctggaatcttagccaccacttcaggacgtactgaaatccttcctgaagatattgatgagtgtctagacttatttctagatgggaagagatctaccaagatattggagcaaagtgagtcttatttgtagtacatacagaaacttttcaagtcaaccaaatagtgaaaataaaatagccctccgcgaacagactcataaaactgaacctagagttgtacttgcaacttcaaagaatggccaagctgtacttccttggagctggttccattggtgggttggtagccacacaaatcagtaatgtgacgaaactggacattgtactcctgctacgtaatgagagacgactgaacaaatatttaaacaataacagcaaatttacctatgaaaacttgaccaatttgaggaaccctaccaaagaagagtaccatttgagggctataagtcacatccccaaagatcatggaggactcccagaacatattgacaacttaataataacaacgaaatgtcaccaaacggttgaggctctggaaccgtacatcagttgtataagtgaaaagaccaatatccttttgattcagaatgggtttggagttgagtcaaaactgaagaagatttggcctcagaataaagttcccaacatgtttcaaggtgtcataagtcatggcgttttcaaggatcgtttctggaatgtaaaacatgttggaaatggagatttaaagattggtcgattagccaatgaagacacagaagttcctcaatttatacaagacttattggtgagcccagttttgaatgctgaactactttccttcaaagaccttttgaaaataagattagaaaaactgatagttaattgttgcataaaccccttaactgccatatatgactgtcttaacggggagttactccaactttcccacagacaatttcatagagtgatcaatgagtctgtcaggtgtttgacagcagataaggagttgaacaagatatttgtcaatgatgcagcgtttgcacagctgatggacagagaaagattactgaaaacagtcctcaaggtttgtgaattaacgaagaggaactcctcttctatgagggaagatgttagacaagtccaccaaaccgaagtggatttcttgaacggatacatcagtgatgtaggtaagaaaaacaaggtattcacgccacacaacgacatactatcagagatggttaaaaatagggtgttgttaaactataaaagggaagaatcaggggcaaggttggtgcaataatttatataaagtttacccctctaataggtccaaatgggtttttgcgatatcaaatcggtcctcgtataatcgtgtgataattctagagtatttttcatcattagaaaactgttgcaggttagtattaaacacttgctggcactcctcaactataccagagagaatttctttgagcatttgtttggatttggcttcaaaagaagtaccttgagtgagtccgtttatgaagttagtgatcctctttgaagagagcccctctggggtttcttggattaccgcaagagctacctgcaccctaaaagacacatcagataatgagacggtataatcgttgtagtacccttgatccttaaggaattccacgtgatgaggctccatcaaagcaatgacttgttcgttgatatcgatatagttccagctattcatacccctttcaaacatgaatccatattcacaaagcaggaactcattggaatgagcaccatatttgaagtagagttgggaattctcaggatagttcagaccagaagtaacctgaaatccgaaactattaattttcacagtacagccatcctcgctggagtggttcaaaaagtccacatagggaaccatggtgaagttatcttctttggacttgtttaggaacgacggaagttccatatataggcatctagaattgcaacacatccacatgcgcaggaattctctctttgatatcaatcgttcgacttctatgttaatgtatttcgttgaaagtaggttaatgatgactgaatagtccaaattgaatctctctagttgggccaaagcatgagcttgggtgggaggtggtagttttctgaaaaagatttcattggtattttccaccaaccatattaagggagcatatgcaaagtcactcaacagtgctaacacctctataaaaggcttccaaaaggaattcttcttgtgactttctatgaccagaaacatggagatcaattggtacgatgataaatccatcaattcgtcacctttgaattgctgatagataagattgtaatcgctatcttcgggggatggagatggaatatttgcaatccggtactcgttagggatgtcaaaagttttattgctgatcttttctatgtgtaacagtattgtgataaagttgagcataaactctctgggtatggtaaccaggtgctcattcgtcttgagtgattgtactgtatatatggactttcctgtgcttgagtcgtcgacaatccataacttttcggaaataaacgttttattgctgctctgaagccatgtcattagctgggcatatttatccactagcatcttgcggttttaagtatggtatcaaaagtgggaaaatggggtgaaaaatgatgaataaaaggaggcaaccaaatctaaaacaagcaggtggtgaactttgaatttatggggcagttgaagaatccgatacagtttttgtacctgctatatgaggtggataatagacctgctgaatgggttggaaaaaaaaaaaatcggaactgacagttcttttaatgcaagatttcaattttttaagcaaagaaaggaatttttttggtggaaaaaaaaaaagaatcgcgaaggaaatagccatattacggcgtttgcctccggctggtggagaaaagtccatgcatgtcttcccgcgaattctacctcatatctgatatcagactaaaggacatttgacctacaagatcatgctagtattggggcttacaggaggtattgcctctggaaagagcacattgagccaacatctggcaaatgacaaagacatatcgatagttgacgccgacaagattgccagggaaatagtataccctggtaaacctgcttacaagaagatcgtccaatactttggccccaagattcccaatctggtctcaaaagatggttccctagatagacacaatctcggaaactatgtgtttcagaacaaggctgaattgggtgtattaaatggtatcactcacccacaagttagatgggagatgttcaaggaaatgatttgggcttatctctcgttcaaaagaatcgtacttctggacgttccgctattgtttgaagccaagatgggcaatatctgtggttcaattatcgtggtaacatctgatcacgatttgaaaatggaacggctaagagcgagaaacccagaactgtctctagaagaatgtgaatctcgtatcaacgcccagatgtcagatgaggagaagtccgcattggctgatgtcacaatagccaacaatggcacgaaggaagaatttggaaacaagatcgatatagtaatttctacgttgaaaccatctaaatggtggacaatgctgtctctttttccgttaataggagggctgagtgccatatactacctacttcaaaggcgaagacacatgaaccaaatcaaaaataaagccaaagagacgtgaacaatttgtattaggccctccagtattgtgcaagattatgtaatcggtcaataaccacgggcaagaatgcattcacgctgtcattgattaagttttggaaatgtaacactgcatcttcgtcgttaagttctagcatgaatttttcctgaattttgagaatgatttcggttttttcctgctcatcagagtttttcgttctgagcaaggggatacttgagtctatcatcaattgcactagattcaaaattagacttgagttctttcttagtgtaatataggtgatgaaacaataattgcagaataacttataattttcatcattcaggccccccataccttcgatgacctgaataggcagtttcattaatggagggaacggtttaggatcttctcctaagatgtatccaaaatccacgtggaagaagtgcccgtccttggacaacaataaattatccaagtgacgatctcccactcccaggagataagtaatgacacagtagcctgcgcaggaacggacataattgtccattacttcagcccgcacccctaggcttgaatttggatcaggattattttgtttcaaaaatgacaagacagagccgttattcttgagaatggatgacagggcttcattgggaataaactccataagaccttccattgcacccatagacaaaatcttatatggagtcaatttcatatcaaggttttcattttgaaggattctttccattaatgtgatcaattgaataacaaactgatcctgacgtagatcgtcaccaattttgtacatcactggatatgaggagttatctatagttttgaacgtaatttttaaaggagataatgaacttcggaagactgatgattgttcagggattgttccggatacttcgatcgctgggtttaatggaagatgaatgggtggaaaggatgataaagaccatttaccttgccttttttcagataatagggactttagaatctcaattttggccggagttgtttccttcttaaattcgttcctgattcgaagagagatattctgaattgccttcattactaggacctgttctttcaacgattttaccttcattttcccattttcatgtgttgacatttccacaataaagtgagttagcgtaatcttaaagatgttcgaagacttcttattaatggtaatagtcgaaggacttccagcgtccggtgacctagtatcttcttcgatgaactcttcatagctacctgaaggattaacaggttgtttgacatcttgcaataattcaccgtcagtttccactttcagacaccaatagaagaagttagtcaacctctcgttctcaatagacctttgaatcagaaatctggccagtggagagttgagatcaggcagttttttatgtttttgttttagatatctgaaatctgttagcagacggaagatcggatcatcatccacaaacgtgtatttgctagaaacaatgtcgtcggaaaatgaagagtccagcatttcttcataatcatagtttccagtttcataacgaagacattgaaccagttgtaccaaataaaattcaaggtctttatcaggggccaatctcaacctgtctatagccatattcctgactattgggttctgataattgcctcgcaagagttccagacaatccacgatctcaagctgtgtgataaatacaaatctatgatccatttgactagttaattcttgttcgtcactgtttgttgattctggtactttgtcgatcagtgtaaggaactctttcacctcaaaatcgtcatcccaattgatagccttcatgaagtttactgtgaagttgttgaactgtgaagatgtgtagtttttgttaagtattaaattgttcagtacaaagaatcgatatttccatatcagattcttttcttgaagggtcaacttttcgaaaaattgtttgcgtagtacatttataatattctcccgcattttcaaagttggcttgatgtctttatttgtaaatgagctttgatgggttcgttctagttttcggaactttaactctatcggatcgtcgtttcgactatctctgtactgttcaggatcaaaaacattcctgtcaggtgtctgaagtgcagattcgatattgttggaaagaaggtcgttttcattgattgcacttccaattttgtcagttatcgtcgggatattaatcaaggaatattttacatcggaataaacaactggaatgtcaaatgtcttgaattcaacatgcagataacaatttttttggctgtataacttgtttagctgactaattttcttgttgctcaattcattcagccaacttagagactggttttgcttaccgtttatttcgaaattcttgatttttctctgcaaattaacatcgtctagtccatgcttggtgtggctagcctcggtgacctctccgttctctgaagatagctttacaggaatcttttgacttcctcttttcagggcacagctatactcaaattcgtcatcattttcaatattgaaaatgttcaattctgtaaatccaacaacaattctctctcctgtttgcccatggtaatcaaacaggataaagcgaagtttacatgttaaaggcaattgactgtaatgaatggggaattttatccagagacttctagagtcatttcgtttttccttgaataaataatgatggacagagtgggagtattttactatcttggtaattgatggtaatagtagtttgttatcagctactagctgaattgtaaggaagatttcgtggttatgacgatattcttcattggttgctttatagccttcaaatgataagatcttgatttggaagggtatcttgagatctttggagagacagaagctcaccgagttgttctctttctccatatgaaggatgtgaatacactctatgacttgtatgattgatcagctgaaatccaaaccccctccagctagtcccttcgcgagacgagatctggaagggagcttttttagcagacaatctcccactaatcgaggaacactaaacggtaacttacccggcccagcagagatttggtttttattctcctcttctgcctagccctcttagtgactaactattttgaggccatctttccgtcgaatcaatctctgtttcataatcaagtatacgtgctgtaactaaagtcccccctagacctttgaactattgctcttaataagacaccactatatatactagttaccttatcttgttgtatccttgctaaatgaacaacgacttccctccggacacgatgatggggtcttttagatttgaaaatcccgcccagaatcaacagcaacagcaacagcaacaacagcggcagcaggggcagggacagcagttcacatcactaccaaatcaacagtttcctcaacaacaattgcagcatctacctccccacggtcacccttactacggattgccgcccccaggccaagcccctctgtacaacaacggaacaacactccaacaatcatatggtacgcctcctacgtttaatgcaggatatgctgatatttcgggcaataacttccagcctagtgtgatccaaggaaatgtccctttactcaatcatcagggctcgtttcaagcatctccaatgcagaccccgattgaaataatagagagacaacgattagaacagcagcaacagcaacagcatcaacagcaacagcatcaactacatcagcagaaagttcagcaacctcaacaagatcagcttcacaaccattaccaaggtcaatcagtcaaaggcccagaatctttgagaccgctggacttctactatcccaagtcgcagacaacgaatgtcgtcaataaaaggccaatccaatctgaggtgattgatttggtatccaaaaaacctaaacaggaaaataaagctccgagctcaactacactttatcctcctttcaatgtgtggcttgatcagtatagagccaaacagcgtgttcagtattcagagaacgaactgaaaattctcttgctgaaactcggaagagacaacgaaaaatcaaaaactatccaattgctgggtggcattttcaatgaaatgacggccgtagattacaaatataaagcaattttggtcgacaacatatttagttacttcccatgggccaaagagaacaaacacgatctggtcaaagtttatatgaaagttgcaagttggctcatcattctttcaaggcgaaggaagaagatgcagttaaaacttatcttgactttttccaaaaggcatctttgactcctgagatgatttctcttttcaagttggataaagttttagccaagatagaaaaatcaaagaactttggtgagccattgaaggtaatcgctagacagatcagtgcatctttatctgttgataagcccaaatctacgaatggaggtttgagcaattctgcatcttctgcaacagtgaaagcaaatgctttcaaaggattttcctccttgtcaaaatctgctgttgccccagctagcaagacgaaaaaacctactgtatttgtaagagataatactacaggaaactccaatgcagagagcattaaggattcctcatcatcggcatcatcatccacttctcctccacctgctgcatccaataagacgacaactcaaccagcaaagaaagcctcagggggttggtcattatcagactatattacaaagtctaaatctaccactgagtcaacgaacgaacctcgctcctcttcacagccgctagaggagaaagaaaaagatgacaaggtgacacccgacgagaagggcttgggccttgtaagtatcttgaaaaagcccaatcatcccaaatccaaaaagaaggagggtgtgcgtttcaatgatgccaatttggttcaaataaaacacattgtaccggagtggattcttacaggtgaaacttacaatcattctgaatttgacctaaaggagggttcggcattgaaaagtctcaatcacattcagcaagaagatgaattgcctccaatagatgatacgttaccgacttctgctccagttcgattagaacttcctacacctacagaatacatagtcacggtgaacgacttgaatacatataagctagaggtctacgacgtcaaacaacttgagaactacgaagaggagctcaagataaaccccacttcccgaggtggtgaagcttcagttcccggtcaagaagtagagaggcaaatttataatgacggtaaggcaccctacgatagtgtgcttcaagcaactccaacagaaccagattcagttatcaatgaacgaccagttgcttgcataactaagacaatatcatcattttgttaaagtagtcttgttacacctcattacatccgcgatacttcctctgttgttaggcggggagtagttcgttggccttctggcctttgtttgttgtattatatataatttactacttaatggatacatcaagctctcaatcgtactttcagccgataatagagcctccgggcagtagattgttccgtttctttccatctcaaaatccatcagatgctaactgggattatccagcgcctcagaaccctgatatttcttttccttcacaagattattctgagtggtcactaagtactaacaaccgtggtgcaaactacactctgggtgacacttccagtatgaaagacgaggaggagatctggtcgttatcccagttctcacttgaaaataagaagccggtcaccgataatagcattgaagagattggcagaaacaacgtcacaccaagcatagaacccatcatgcagagtgaaaaatcgaatgcaacgtctggtaggtcaatgcaaaaggaaaacctccgaagaagttccaggatccgcaaagtcgtcaattgtagagatgcttccagaagaaaaccaaagaactcaattcgatcaaagcatggttgttggacttgtcgtctacgaagaaaaaaatgccccgaggatggcaatcaatgctcagcttgcttgaggcttggaattgaatgtgatagttcccttcaatcgaaaccagaatacctgatttgcaaggccgctggcagggaaaaaatgcgccaaataaaaaagataacgagaagcaaaaaacaatcatgaacatatttcaagtttgcttctagatttcaaaagctggtcaaccatatatgagatagctttaattcgaaaggcgtcttcatcagattcaacgtcattatggggagcttcttttgggcgctcaccaatgagtttcttataactatcctgagatttgtctaatatccaagagtcattgaaatctttgaagcgacatccaatgggaacaaactctttcaaatcgacatcttcataaaaataatactgccgctgtggtttcgatatacaaagctcgtccttgttcaccaataaagaggcaacttcacaaatgtgaactaagttgtcaaaagttgaagagtttgcgagtaaataattcaacggtagcccaccttggttcgcccagcaaaggaaaagtcggactagtggcaacaatccggtgttgatcgaataaccagacgtgcaaatcgttaagatttcatcaatgaaatgaaacacaaactggaggtaggcctctagaagattttctgacctgtctatccactcatggttgaacttggcattagaaagaatagtgtatccactgatcaaaatgatggcttgtttccacaaaatcttcacgtgtgctggtcgatgaatatccaaggtagctatcgatttccggtagtcattttcaatgttcttccaagaaacatcagtaaacttcatattttgagagtcattccacctttgtggaagaaaatgaaatccaaaaatggctatgaaataattattacatttaaccaacttactatctacagtagagcggcatttttcaggttctaaaattgcccttgaaactgtattaaggagcatttcgcttgataaatgcagaatcaggttcataaatccattaggtgagtgaattcgagtcatcgttgatcgggcaaagttgtagattatattaaagtcgttccgtcttaacctctcgatcagcccgatgtggttgtggggatcaccttgagagggcaaaagcaaaatagcaagattcaagcattctaagcactttctgtattccttcttatcctgacgggataaagaaccagggggtaaataattagttgctaagagggtgcggtatcttgagaggttcccgaagtataataaggatctgtgaatcacatatatcagctgcgaacatacagccaatcctttgatatttttgcagcttccgtttggattttcaatacgcaacagcctgcaaatatggtcaatagaaccgattgcgtccaaattgtatgctgaaagcagttctgtgatcagttggatatgaaactggcaaaaaattctattacacttgaggtaaacgctatagagctttctaatctccaccactctttttcgaccccgaaacttcttgctaataccattactatctaatgtagtcctgacgatcttgtcatttgctaaccttttcaactgaagctcaaagtattttatagttggccgttgaaaatctagccaatactgatcaacaagctcagtaaacaccacaggggcctggaaacactcaattgtgttatctgtggctataacatttgctatatctttcacaatcaacattttcaactgatgactgctcagctgaacaaaatctatcaatgcagcggaatctacaaatcctgattggagtaggccatcgttttggaatttcagttgttgaagtgttttcgtcacatttccaaaattcattcccaagctctagcaaacaatcagtgtgattcaccccggttcacaatcctcatcaaaccaccaaccaaagactacatgctttcagttttttagatagacgcgcttactgtttatgtcgcgacgactgttctcgtctaggcttcacctctgttcatttatcaggctttactccatcagagcactttcaatctactagcttctaatctgatcggatcggcttaagagatggaatctgaagctccatataatttcatcagtagtaatgggacaataccagatttaagaagaccatcggcaagggtagctaaagtccaactcttgatagcgtctctgcttgggggcatcacgtttttggttttttgtgtcttacgatgtcaatttcccaacatatacatggcaaggctaaactatgtgaataaggccaacaggaagtttacgccaccacctttgtcgaggacgtcattgtttggatggatccccacgttggttagtattggcgaccaagatgtcttgaccaacgccggattagatgcctatgtcttcctcggattcttcaagatggcgataaagctactaagtacttgtttggtatttgcggtactggtaatatcgccaattaggtttcatttcactggaaggtatgatcaaggcgatgatggtgatgatggagatgccaataaacaagatgatggttttatcaatccagaaaactaccacacatatctatggctatatgtcgtattttcatatgttttcacacttatagttggctattttctgcaaaaacaaaccaaacatgtcgtagaaatcaggcagtcgtatttgggaaagcaaaactctatcacagacagaacaatccgccttagtgggatccctccagaattgaggtcagagagacttctgaaggaacatattgaatctctgaatattgggtctgtgtcttcggttgtgatatgcagggagtggaaaccgttgatcgtgttatttaaacagagagaacaaattgttgatatcttggaatcgtattgggctaccgttctagaagctacagatctatccaatataaggccgtatgtaagtgattccattagattgcttaacactccagttgatgaagaagctgcttttcacgacgacgtcccaccaaacgatgtgtcaagtttgattaactcagatgatgagcaaactgacggacctgacgattctatcaattattcttcctcggccctaagcctaatcactacacaacatcccaagcgtccaaaaattcgtactcgctgttttgggctgggagggaaaagagttgatgcaatcgattactatactcatcaactgaaggtcattgatgaagccatcattgaagcaagagaaaaacactatccacccacacctgcggcgttcattacaatggatactgtagcgacagcacagatgatggctcaagctgtattggaccccaacgttcattacctaattacaagattggcaccagcccctcacgatatcatatggtccaacgtttgcctccccaggaaggagagattgtttaaagtctatgctataacaatcatcataggcataacaagtattgcactcgtgtttccagttttgtacctgacaacgctgttaaatctcaaaacgatttccaagttttggccttatttagggaagttacttaaaaaacatcactgggctcaaacgttggtgacgggattgttacctacatacctttttacccttctgaattttgttgtgccatttttttacgtctggttgtcttccaaacaagggtttgtttctcatggtgaagaggaactgtctaccgtatccaagaactttttttacatatttgtgaatctgtttttagtgttcacttttggtggtacagttagtaactattggggttttttgagcgatacgacaaagatcgcataccaacttgcaaaagctttacaagaattatcactcttttatgttgatttgattatcttgcaaggtttaggaatgtttccatttaaactacttttggtaggccaattgtttcgattcccctatttcaaaatcaagtccaagaccccaagacattttagaaatctctataaacccccatttttcaactttggcttgcaattaccgcagccaattctcatcttggtgattactattatttacagtgtgatgtcgacaaaaattttatctgcaggattggtttattttattattggctactatgtttataaataccagttggtctatgctacagtacatcctcagcactccactggtggggtttgggcattaatttttagacgagttgtaatgggtttgcttctattccaagtcactatggccggtactttggctttacaaaatgcttatttgttagccacgacattgatacctttaccgttttttactgtggcatttttgtggaattatcagaagaactattatcctttgtcatcattcattgctcttcgagctatccaaaacaacgatatcgtgggaagaagacacaaccacattaataggagtaggaccagtgtcgatagtgaagctaccaatcttcaacccaactcaagcaacacattagacgagagaagagagttgaatcagacttatgaatatcctttccttgttcaatcattagatggtccttggttagatatagatggagatgaggtaataatggcatcttctgaaggacccatcaggaagagacatcaattccatgaatgggaatatgatgatgtgaatccaaacgtattaggccaatcttggtaatcatattttaacttagactcaattcggataaggcgtcacgcaaactggacaaaagtcccatgctgtgatcataatcattttgtataagagaactgaaactgtaagaatacaagcgactaataaaaaaacaaaccagcagcctgcttgtcaaagctttgacatagttgctccaggttacgattgccaacagtttccaatgtgacttagaattattatttatgagtattgtgttcaaacagtcaattgtgatgaaattattaacaaaatttatggcacttttggtcaatttcaatgcttgaatgtcataaggccaaatcaacatagctatcggaaataacctgatgatacttgaaatgcagattgtgaaagagattaccactgggaagaaatactttggatactcctgaaaataggaaggatcagggaatttcaaccagtatctaatcaaaagttgcattgctatatgactggaaactagatctaaaactgatttgaagaagaagaacaaatattgtgaagcaatggaaaaatctttgaggacaagttctttgacaatagaatgctgagatgagctataacttttctcttcatatgcccaattaacgtaaacttcgaacagcaacaatagcatccatatacgaaaaactcttgtgtatatttgtggctggaaatgtttctcgtcttggttctgggttggaatgagtgagttgtacatcagatgtctataagcatttggtctcaataggagcaagtcaataaacaacactactttatcaaattcaacgtacttgtctactacctgattgcatttggagcatatggtaagcttgatgtacccattttttgattgaaagtatagattgtcgacgggctggcaacattctatacaaatcatatcaaaggacgaagatatatgtagggccagagggagttgttgatgctagtctgaatgcgcgattgtgcttatcgtcgacctccgacatctactataacctaagaaagaatcgccaaagaattgatgtgccattgaataacatccaagatggacttgacttcgtcttttttcttcaccaatacctaaatagactgtttaattaattattcatcgtaaatggttcatttccatcatctgaccgttcatttgattttttttctcagatgaaacggccactttgtttttaatcagtgaatgaatatggttaaggaagtcatggtagctttggagcttgtcaggcgtactatcttcgtacaagttttccatgaattcaacttccgcaccatctcgtcggaaccgacaaatttgtattggtacaaaagaagagttgagatagctcttagcaaaaaatgaaaccaggtttctgagctggagagagattcctgtatccagttcaggtagctcgtttaaatttggatcaatgctgtccaaagaagaaacattctgtccaaatacatcttgaagcaacaatacattcacgtccgaatggatccagaaaaatactttgagcccgttgaacaatatgtatgcacctccgtgcattaagttttgacgtgaaagtcttgtccccggaggtagttggaaatgtcccgtggaagtatactggcatgcgtcctcatctatctcaagaacgtttatgaggatcgggtataaatacactgcgagcttctcgagagtgaacgacttaagatccaagatagattgaactcttagatcagtgttattagatggcgcgctgcgaattgcacgagtcttcgttgcagcaagtgtaaacatgggaagtgttcgcaaaccaacaggaaggattaactgttggtctgctgaagactttcctaccacttttaacttgtagtcggtattaatgtcaactaagtcaaatgtgagacgatttctaagtcccactagtgatacttcagggatcctacctagatgctctttcaattccaaggccagagtggcatcttgatctgcaaaagcaaatacgtcagctatcctctcagttactgaaatgattgaattgatcactcttacttttctcacaccatcagctgaggtatacaataaagcagcctgaaaatgggcatcattcttagtagagagttttccatcatgcttgaataagcagcccacagaagtattggaggtaacaattggtataagtggatcagcgtccgagtttgaagtcttgaaacttcctaagtatttcgtcacttgcaacccagcagaacaacgaatcttcagctgtgattggtagcctttgacagcttgtatactgtcaagtaatgatatacaaagggatttctgatctctcgcaacttcatagttgaagaaagatcttacgctgcctccagtactagttgctaccagtgaacaatccgaaaggtctacggatccagaagaaacaacaaacaggtctaaaccaacacttgcgctgatatagtccttcgacaatttctgataatattgattctttgctgttaaagcttcggtctccaattcagaagtgagcctttgacttggggatattcccttgagagaacctggaccccagctgggcaatgcagatagcagagcagtaaccttacctccaccaacatgttccaaggctaggagggcatacctcaatgcggcaccatatgcaggttctggttctgaatattcgcccatcatttctaacgactgcagagctcggtcaatgtgtatccttcctgctttaacatccacaaaaatgccatcaaaaaatggtagaaaggggtcttctaagtcacttacagtggcaatagaaacttggtttgaatcaagagaaaggttaaaaaaatgaattttcctatcatatgcaattattgaaatctttgaacctttaggatagcctttcaaaactgacatggatatggcattggcaaaagccttgtggagttcccttctcacactagagttacttatatccacaagaaaaacatggtgcagcggatttggaggaattgattcatcgatattgtaggcctctggaaccaaaaaatctatcattcccagatgaagctctggacgttgattcctatcgatacggacaccgctaggatccaaaggagagcaatattcgcttggaataggactcgagaacccacaaatattacaaatcattctataatcgtgggtatgttgcatcgttgaattcacataagcacggcatctgcgacatcttggaggaccacccatctctctgtaatctacttctggaattggtttttcctgttcttgcatcggtgcaaatggattcagcacaagcccaagtgacaatccagtctccttgcgcaacttttcagtagccgggacattgtacatactcattctcataaatctgggcgacgcattaccttgatctaccacagtatattgagtaccaacaagtggagggcacacatttgcaaaagtcaagaaagatttggagtcaaacataacgtcagtctcatatcttatatctggcaccgatgttggatcaaggttagatggaggtgaaaacgtctgatgcagttgtcctggagattggatttgcccttgaggggtaccaaattgagatacgccaagtggcggcgtacccatttggggagtaccaatttgaggggagccttgtacaaaatttggggattgaggctgttgactaaaaggcacttgtggtggcaagaagggctgtgaagatgcaggttgatggaactgtgctgtagtttgagatgcaggttgttgatgaagaatgtgtactggtcgtttcttgtgttttgactggtcgaccttcaactcagacatgccgtcacttaaggagctcatggaatagccatcataaacagcattcatggagtgtgtagcttccattgcgggtgctgatgaggccacagatagaacaagttgatgtttttctgcctctaagatgctgattccataggacggtgaacggaagagttcgcgagggagatctaaagacgcgcttttgaaatttccctactcgcgtcttgcgaggtgaagtatacacagtaccgctgactttcttctctattgcattaaggtcgtacttgataaacctggttgacctctaaaggtgttgtcattttttttagcatatgggtgtaaccggtcttctaccagcaattaagaatgctcagaaaccaaccaatttggagtcttttagaggttctacactagcaattgacacctatgcctggctccatagggctactacaaccagttggtacgagctttctcatggagttgccacgaaaaagtatattcagtatgtcatgaaacgagttgagatgctatttcatttccaaatcactccatactttgtgtttgacggcgattacctgccatgtaaggctgaaactgaagctaaaagagaagcacgaagaaaggagtatcgtaaattgggcgatcaagctcaactacagggaaatcgtaaattggcaatgaattactaccagaaatgttgcgatgtgactcctgaaatggcaaaggccttaattgatgagttcaaggctagacagatctcttttgtagtggcaccctatgaggcagatgctcaaatggtataccttgaaatgaaaggatttgttgatggaattattagtgaagattctgatcttcttgtttttggatcccgcagtctcatcactaaactgaatgaccgaggagagtgtatccatgtccaaagaaataatttcaaagattgcgccaatattcctggccttgctcacttgagtcaacaccaatttcgcattgttgcctccttaagtggatgtgactatacaaagggaattccagggattggtgtcatcaaagcatttcaattggttcgaaagtacgaatctattgacaaaatattttccgcattacgtttggatgggaagttcaaaatcccagcctcattcgaaactgaatatagactagcatgccttgcatttcaatttcaacttgtctttgacccaaaactgcataagccagtccatttgactgatattccgaaagatctccatgaagatttggatctcatatattcttgtgctgggcctagatacgatgattcactccatgttagagttgcgtatggtgagttgaatccgattacaaaggagccattgatttctcgggagatcatgttacaacaaaaccagtcatcattttgtactcaaaaacctgcaatcaataccacgttgaccgcaaaaaggttttataccagtcccgatattgaagctgctgctgttccccagttaagtacgcctaacattgattccttctttaagcgtcgtctcactgccacttccaaggttcagactgccataattacacagaagaaatctggaccaattgcggaatcgtctccagccaaccttattgtctccaagagaaagaagctatttttagaagaagaagagtttgaagaagaatccagtagattcttcaaatctaaatcaggagagagaaagattgatactttggaaggtctaaactccagcgattttgaactgagtgacgttgacaccgataaagaaaaccaggagccccataccactaccaaggatgaaaacactggtgtccaattgatgacaccgatcccttctgtcacctgtgactggaaaactaaatatactttacaagagttgccggaattcactccctcaaagactgccaaaagagtcctcaaaccatctggaaataggaagaaaggaattaatcttccatctccttctgctgcgtccaccccattgaagtccttgaaggattcccccaattcaatcaccctggacaggttcatattcagaggatagagccttcagtggaacatccggcatccatcatttaaattctctcgcgtctgcatattgggtaatgatagagtatcatccttacatggatacccagacaaaactcaaccttcttaagaaaaattatcctgaagttaacgaagaagtgttactagagctattactatcatgtcgtgggtcatttaagcaaacagttctacttttgaacgaacagtttgacaatgaaaaagcgtcaagcgtttgccacactccctcatatcaaagctctttgaatgacttatggggctctaacaaacgacaaaggatcgaaggttcaggaaacgttatgctttatactaaagaatccattgaaaccactattccttacgtctcatatcacaagagtttccttccagcggagttggcggatagagtgctaaagtatcttttagatttagatatatgcacattcaatgaattctacatcgcaggcaagaaatgtatatccacgcataagacttgtttaatgacttctgaggattttatcagggagtccaaagataatgtcaatatgaataatttctacataagaggcaatcccaaaaaatcaattccatacaactccgacctaacagtcattcaaagccttattcaagatttggtaaatgaaacactagctcaacgagatctttccaagacaccatttcacaaccgcagaccctggaatggaggttcattagtttgcaatcggtatgattccatcaaaagtagtctagactggcattctgacagattaacttttatgggaccgcatcctgtcattgtatccctctcatttggttgcacgaggtattttcgattaagaaagatacacccccataaaggatccaacttacctccagtctataacattcctgtgcctcataacactttattaatcatgtatggaggatgccaagaagagtacaagcactgcgtggctccgctaccctcaattattgattccttgcatcctatatctggcgagaccaggattaatttgacctaccggcactatgattccgaatgggtcagcagaatacccagatgccccgaatgtaatgagccaatgactttgaggcgaatgttcaaaaagatagagaaccggggcaaatattattggtcttgtagtgcccaaacttccaagaatagtgagtgtaaagggttctattgggccaaatttgatgattatttagaagggaagctgaaggattatacacttttttctaaagatgaggacgaatgttctcaatggattgcggaagatgactgggagaagctggactacttaaaagagtactacaaagatttgctattacaaaggaagaagaatccagaatagcttttatcgtaaagggagtatattatttcatctatgtattgactaatctatagtcaaacaaaatcataattcattaactagacaccaccatctagtcggttttctaggtatatcctgatgtggaacattccgtcatttaagtttttgaagtggatgaacttgtagttattctcatacaagaaatcaaaaaatgactcacctatcttgagaaatttcaaacctacttcaaaattaattagctcgttcagcatgaacaggcggtctgaatcgttattacgaccggaattttcatttccttcatcagcaagtaatacgctattcaaagttgtgggagatattttttcatccttggcattcatagcatcagcagcatttgtgtcattgttagaagcagcatgagtgttcagtatattggatattgagagacttgaaaactctgtctcaaagtcatgatagttgaatttgaacttcataaacttttctaaatccagatacagccggaaaaatgtttgatagatgtggaaaagctgatcaagcttttcatcaatatctgttttcatataatcattctggttcatttgggtgttattgataaccgaggagagttcgaaatgatgcaagaagcttatattcgaattagaattgtagtaattaaacttgtgtttgatcttcataaacttctcgtaattggtaattatcttgtagatcatcaaaaatatatcgaataatattgtcaaattcaaggatattttctcatcaaaattgtcaaatgttaaatttaactcttgcaatttgaagtcattttcatcctcataattgtctttgacattgttatagaaaatgagtttcataatcttgatgatgattagactcaaattaatcatgtcatccacaaactctatgtcattgtacttcttttgaatactgggagcaggaatgttcatgaagctgttataatagatagcacacacttgattccagtttttaagccacacgttttcttttaacttattcaaagaactaacgtctccggtcgaaactttcaatgagctcttgacaatcaggaaattattaagcaactttgagtccaaaatcaagcaactctgctgatatatcttctttggaaacaaatcagaattcgaaatcatcctatcccaactgtgaagtgaattaacaacctttgtgaatagcgcatcttctctgttattgacagcagtcaatttttggaaatagctgtattggtgtagaccattctgtaggcatatgagtccaaactcacttacatggttttcatacaaaaattttccatcgctcaatggctgattgtaatcaatcaaattctgtagtactcttgtatattgaaaagggatctgatttccgtaacttagacttttgaatttcacaaaagaatcagcttgccaaagtgttgtgggaactggtagagtaatcattaggtcatcaattttcaacgatggaataatattgtacaaggcgcttaagttggaactgatttgaaaaatcgtgtggattgtccttacggtggactctattttcacgaattgattccagagttcattatccaaaggtttgttgatgttgaaaagatctataattgaggtcctattcaggcccgaagtcttgaccagagaattaagtgcgttaacttgtctgatcacgacattcaaactaatgtcattgtccgcaaataacccatacataacagataacgtcagggattgaattagccaaagtggagagtcattgttatttgcggacaaggaagtgggtatctttttcctggaatctaagtaaacatgaatacaacgccttgaagcttcgtataaattcgaagcatcctttttgttgtttgatagtactgcacctatcgtagccaccaaaagaggaagacaaacaattgatattcgttggttctctaagtaaaactgattattttcccagttcttagtcgactcattctcatctaaaattgccttgaaaagggagtattctttgagaatcgtgacatgtatgaaaggataatgatttaagaaacggttggtgaatgaatcagcatattcatttagtctttcgttctccggaagagttggagtgggcacaccaataaaaggatacttggaaagagcgtagtgaataaacgaccgcatgttgctggtaaaaagaacttcggtggaatatttcgagttgtttttttgaggagggggaggggcttgactcatttcagaggtgacactttgtgttctaaattctggtctcacgtcactagtggagttattattaatggagttatcgagtagaatgggcgaaattgtggcattagaagaagtgcatgataacgtgttagagaaagtctgttggtccaaattaccatagaaggaataaccagttggcaagcaaaaattcttggatgcattcaaagaagactcaagttcttgaatggtattagcagccggtgcggagttattatccacggtgtctggagagtcgtcatttgttttatacttgtttctctttgtattcctgacagaaaatagggattctaatggcttgatgggggcttcgtaaaaagagtagccattcaacttcttgtcgtttggagcggtgtccttgggcggttcggatataataggctctgaattcttgtgttgtatatctgtaaagctatcaccaatgttcctgttcacatcgagagagaagttcggaattggacccatgttgttcatccaagtttcagcatcttcaacgggcatcatttgtggggtagaaaattcaatattctcaaattcggcattatttgaatcttgatttggattggtagaagaggcatcttgttgaaaattattcacataatgggcataattatttccactaacggcggagaaggaagctcttcttagtccaagatcaaacaaattgtttacgtgatggttggaatcattgaataattgcattctcggggatatcaatggatcttgatcaggctgctggacttgattttcatgctgcttaagagattgttggtattgcaactgtggttgttgctgtagatgttgttgttgcagttgcagtttctgttcatttgagtcccggcggccggccagtttctgaacttttcgtttctcgccatcttcgggcgtacccatagtatttggcgttgtcaccggagtagaaccagatatggaacccgcggcattagaagaccgacgagttgccttgcgccttagtcttgttatggccgcatcagagcagttgctgtgcagtttttgggcatgtctcaataacagatctcgacggctgaatttacgagaacaaatgccgcagctgaaaggtttctccttggtgtgagacctttcgtgtcgtttcaagtgttcctgacgagcaaatgctcgagtacatgtctgacagacaaataagcgtagctttcctgagggtgtggtcccattgaatgacagctccttgggcacgggaggtgattggtcttctggagattgtctagtggaaccaaaagttgggggtagattgctcattgtgcgtgggataaagtcatcaaacagttgaacacaatgaacccagaagaacaattaataggagtgggggtttagaaaagaaaatggaaaacggtaatggtataaaaagtccttcggtccgagtactttttttttttgatggtttttttagctagttctgtgtatcaaatgggaaaaaattcatagatgtgtgttccatcttaagtttcggagtcaaatgcctgaaaatattagtagtgtgccaaccacattacttccccgcatttactctttattatcggacggtctccggcgttgggaaaagaggttggtggaattagagcgagcaggaggttatggccgaacgggaggcaaaatgcggaaaaagagggatagaaatcatgtggtgtgcttagagaaaaaaaaggggccacgacaaccaactatacgtcaactacacaaccgttgagaggagcaaatacgctaaaccccacgcaaaacggccgttgcagtacgccacttgatgacaccgggtttacgatacgattacgatcaggagaaaggtgatgtatagttgatgaccttgcattaactcccaagccttggtatggaaaaagaaatgacttgaaaggagtgatctatataaaactgtgtgacaatcaatattatattaactcgacatccgccattttaatgacctcctgtcgtagggagccctgaataaaccttaaatgagtcatagatcagccattggaatccggtcagggttccgatcatgacgattctgatgcctagaccgttccaaagaccgctgaaacctatcttttggtacaattgggcaacactgagtccttctttattgttgttcattagactcaccatcacgtcagctggatgggatactgcagcacagaaaatacctgcaatgtaccctcccgtgaatgacactgctgtctgttgcaaattcgacagctggtcctttggctttttgatagccttgctatagataagatccacaattttctcaaaactggtgaacttgaccatggtataggggatttgtctgcaccataggggaaccagccctttatacaggctcaactctctaagattgggcttatccggtggtagagtagtctgaattttcaccttcatggcttccaagggacacaggaaaatatcagcaataaactcagctgtagcactagctgcaaggaaggtgaaagtgtttgccttgcctccattcaaatcagtgtactgttttttgaagtactcataaccaccatacttggcagctccttgaagaccatatccaataaacgtgggtaagacaccagtgtagagagcggggaatccctcatttttgataatgctggtgattcctttccaattagaggagtataatgaagaattgacttgacgacggcatttaacaagatccagtggtgttattccaccgtgtgttggtgcacatgctagggctccacccacggtgcaagccaaatagtagtccggtgagtatagggatatcttatcgttacgcatgtgtgaatgtactgaagctgaaaagtgagaaatacttagtgagaacagcagcaaaccatgaatacttatatcgattcaatttgcgttatttagacgtgagtttcaatggacgattgcggatgcttcttatctgagagtttttccgaggagactgcctaaacgagaccaagaagaaaaagcctatgagctgcaaaggagactaattagttcgtgagaacagctccttgtgcgagccggcccatgagaagcaactggtagcattcccactgacttttggtagttccattccttttctttgtggatgatgtcatattctcgagggtgtctgaaattccatagaggttccggatagttatcggttcggcaagtatacatgtaacttacgtaagtcgggggaacgacagttcaaacatgtttttacagcagatgggtgggacttactcttattacttccagtcctgatcctagtcgttacaataagactttcaaagttgtttattctagactacactttagtactagctccgatggacatgttcatctgcgaaataaactgctataactttcaattgagcatgctactaatcctttaatcaaatactaaaggagtctccttcctttcctgcaatttttgctggcttagctcttctagatgttttttattactcttgactcgttcctgatgaagcttcttccccaatgcaccgttgacattcttctcttgtctcttttccgcagcaagagcagcagcttcctttggtgaaagaccattctgtgtgggcacatccccacctaaaggtttaccctgatctttgtgtttaactttaccaacaggtttggttttatttttcggtttagagcttttaacgttagacctggtgtgcttctccgattctctcttttcattcaacccattggtcccttctgaggaacccttggagtctttagatacacagcatcccatggagttcgtacggaatcttggactacgttgcaagtccaagagttctacgcgatcaaatgaatgcttaggtaatctttattcattctttgcaagtgcaagaataactcatcaatacgtagagaacacgatcggcacgagccacccgtcagatgtgacatcttatacctttagtagttgtttatatgtctcccaaagtcgctttcaagctttgtgtgatgtttttgtagctaggatcgttctgtcggacatccagcatccagctacaacgttcaacatccagcgagaagcgaattttcgtcgacaaagcaaacaaagataaggaaggacctacactgaaaggtcccattatgaacaccgcttcccaatataaggcgcaaggaaacggtcagggaatcatgcgacatgctccacagcctcagcaaacgcaaattccttcgcaataccttctccagcaattgcaaggctctcacgccaccaaccagccccagacagattcatccaacccttctctactagttcaggctctctttcaaggtccacagtctcatcaaggtcaaagaattggaaatcagcaaatgcaaccacatgtagttcttggatctcagacgttacaatcttcttctgttgttcctcctggtcaaaaccaacctactagccagagcccccactatgacacaattcaggttgaagatcccaccacttttcattggcagcatcaagtacaattggtgcagatgtcccgaaagtgtaatcagccccatttctatgctcgtcatgctgctgtttcttccagaaagctacttggtaagaatggcaataacaatatgcctggagttgatggttcacaggggaaccaacctccaaacttattggaagccacgaaaacactactaatgagcactgatccaactgcagagcaagccgaatctggtgaaaacaagtctgctaccgacccattactgtggtttaagaagttatccaatgacactcaagatgaggatgaagaaattgatgcttccacgttgaaagatcctactcgtcaattatggagggctttagacctgagtggtcaacagcttctgcatcttagcgagaaattgttccgttatgattttctgaccaaattatatctaaatggaaacggtttaacagaattaccgtccagcattcgtcaactaaagtccttaacggtgctggatgtttcacagaatttactttcttcttttccccctgaattgggaatacttttcaatttgcgttatatttacgcttttgacaacaggttgaccgatataccctttgaatttggtaacctatatgagttagagtttttgggtattgagggcaatgtaaacatgaacccagaatatgtgaatatacttgcaaagcgtggttcaagaggtttaaccattcatttacgcgataatgctccaagaccaacgcctcctaaatcaagacaatggatttacttcagcaacgatggggagattattgaagaacaagaatatagacaacaacagacagaagacgatattgtcaacaccttcacaatgatgacttacaacacgttgtgccagcactatgctaccaagaagatgtatagatacaccccctcgtgggctttagactgggactataggagagagcgattgaaggagcaaatcctagacttgcaaactgatataatttgtctccaagaagttgagcataagacttttgatgatttttggcaaccaatcatgctgtcgcatggatataagggaatcttccacgtaaagagtcgtgctaagacgatgaaggaatcaagtgcatacaaagtagatggttgtgctacattctaccgtacttccaagttccaagccgtagaaaggaaacatttcgagtatggaaggattgccatgtcacaggacaaattcaagaaaacagaagacttgttcaacagatttcttaataaagataacattgcgagtgtacttatcttggaacacataccctctggaaataagctggtagtggccaatacacatttgcattgggatccagagttcaacgatgtgaaaacaatgcaagtaggtgtgttgttagatgaacttcaggcagtgattcgaaagcatttatctcctaaagatataacaaaggttcctctactaatttgtggtgatttcaactctaaagttcatagtgcggtataccaacttttctctcagggaactgttgacaagcatgaggacattataggcagagattacggaaagtttaccgaagaaggcttccgccatcccttccacttacagtcgtcatacgattcaattggtgaactcccatacaccaacgtatcgcccaccttcacagatgttattgactatatttggtattctactccaagtttatcggtgaaaggagttcttggtcaggtcgacccagattacagcaagaacattattgggttccccaatgcagacttcccttcagaccacattcctcttctgagtacttttatgttcaagaagtcgagtgcacctcgaccagacactcgagttgattttcgcagtgatttccgaggatctcgcaagacatagagccagtgatgtataatagtgtttagttgcaaccaataataaacatataggttagtcgatggcactcgtagtttaggcaacgcaacgcaatcttaggaggaaagatgaaccccttaggccccttagggcgcgaaggatgtggttggatatgcctctccgtatctcttccgagccgataaacaacccccaagtagaagaagatatttcatcctcaaaatatcctacgacatgagactaaggcccagtatagttcggccagttcggttgttgtatgggagtcgaaatttcaacactgtcactaagcataggcgttggatagatgttcagaagccgaacagctatggcgatacgttttctgtgagcacctataacattctgaaccaacattacatctggcctcaagtgtttaaatacgtacctgaaaatgatatcgactggaattatagacagcagctgttggataaaaactttagagaccttaatactgacatcatgtgtttccaagagatggaatacgacatttacgatacccattggaaaaactcaggggaatcatctccgttaaaagattaccgaagcatattcgtgaggaagaagccaccacattattggacaaagtccgaaaggaatcttgatggtgtgtctatcttctacaaagattctgtttttgaggtgattgaccatgtagattttgatctggcagatttggtcagagagcatgattttccttcgtttgaacatacagaagacttcaaagagcgtgttctacctagaaatacagttgctttggttgcagcgttgaggcataagcattctggtgaaattgtgatggtaagcacaactcatctgtattggtctcccaaatttcaagatgtaaaattaatacaaatgcttataatatgcaatgtgatccgccaatttcagaaaaaactagagaaaaagggtttactgagcccaaaggaccccattccattaattatatgcggagatttgaacagtcaaatcgattccttcgtttatcagttcctgaagacgggggatatcgatttgcatcgggactatgaaaaatggttcacaaaatacgactacggttcaacattggatcttctgaaatcttctgatcctctcaagttgaaatcttcctataatggactctttcaagctggcaattttccgttcactacatttacagaaaagtacactaacatcatagattatgtctggtacaacaaagaaaagtttgacctaattcgagaactgggtcaagttgatccgtcgtatgtggcaagtcaggttggatttccgaatgatgaattcccaagcgatcatatccctcttgtaaacatatttcagttcaaatagaaagttatatagtaatgataaaagttatgatgatgattacataatccgaaattctttggtcttcccaagtgcagaattgcaacattggccatgtcgcgcgatgtatgtagtagcattactacttgatagccatatacttctaccaagtggtaaaccatggtgaagagtgaatttttcactcaaaggactagtaagaggctcaagctagcctcccagatggcccagagttttggttcgaccatttctgatgttgctttggatggatctagaaggaaaccggctccagcagtgatccaagtaaagaaagaatcggaacctattagtttagaggtgaaaagccacggaaacgatacgaaaagggcacgtgtcaagagtgaagaagacacacatgtaaagctggaagagactccaataccgaagaacttttttcccatttataatgaagttaagttgatccgatctaagattaccactcccgttgattcgatgggatgtgccacaataccaatacgaatcgctgaagaaaaatccggccccctatttagataccgcttactggtatctcttatgctctcttcgcaaactaaagatgaagtcaactatgaagtcatgaagagtatgaacgactatttcaagagtgtggggtacgaaaacggattgtgtttgcaggcgattctagatgtggagcctaccaagctggacgaattgatacataaaataggattccataacaggaaaacagtttacctcaagagtgctgcggtgatagtcaaagagcaattcaacggagatatcccaaagaacataaaacagatcactgcacttccaggtgtaggtcccaaaatgggatatcttttgctacaagacgcctggggaatcaacgatggaataggcgtagacgttcatgtcgatcggttagcaaacatgtggaaatgggtgaatacgaagactccagagcagactagacttgccttggagaagtgggtacccagagagttatggcaggagatcaatccggtgctggtaggatttggtcaagtcatctgcaccccaaggggtcgaagatgcgatgtttgttctcttgcctccaagaagctctgcaacaatattgatagaggcatcatcagtaaaagtcgtcgtgagaaggaatccgcagcattgaggggcgtcgccgttaaagagaggaaaattagaggagatatctcccagatactagacattgaagatctcgcataaggtgattccattatcggcatttttactaatttttatttattagcgatgtagttagtcatactatatttaagcacgtttattttccaagattcgctttttttaccgttttatccataatcactcattagcttatctcccaccgagaaatgtctttgcttatacccagtaaagtagactacgacgacgctcatcctgcgactaatcatttccaggagtacgccacattgctcggtcaacagcctcgagaggactttagctggaaatttgaagttgttccagggtttttcatgcaggcggaagaatctactgacgatctgaaatttcgatacacggaacaacatttcggattaatgttagaatcttggtccgaactcattaaacaggtacatgccttgaacgagtttgctgccgataacgaatgctacaaagtactctttctggccagacatggccaaggattccataacttcgctgtggggaagtatggattaccagaatggaacagaaagtggcgtcatcttaccactgatggagaaattgtctggggaccagatccatacctgacagagaggggtgttaaccaggctttagaaaacagagacgcatggaagaatgagctctctgtaggttgtcctttgcctcaaaaattttactcctcaccattcacaagaagtgcaatgacattggtaaacacttggaacgagattcttgacctgaaaagagttgctccaatgattaaggaaaatcttagagaaaccattggtgtcaacagatgtgaccagaggtcagacaagaaaaccatcgagaaaagatatgccaatcaatacggatttcagttcgagcccggttttcatgaaatagacgattacttcactgaggaatggagagagtcaatcggtgagcaaaccttgagaataaatagattcttgcaattcctgttcgatctggattggaattcagaagagggaaaagctaaaaaccgtcgtgattcgactttcgtcagttgtacaagtcatgcaggaacaatacgttccttcctacaagttttaggtcaccgtgagtttactgtcggcaccggagcaatgattcctgttgttgtaaaaggcattagacattttaattgacatagttagatagagccttcttaacaccttccaaactctttgttgcaaaaaatcgcacgtccacatcttcatcattggtcaattgtaccaattgagggataatcgtggactctattactggtgcctccttggggtcgttagctagcaaagtttcaccaataacctggtaagccttggcaacgttgaaacgaatatttggcacctcatccttgatcaatctttcaaaaaatgggtaaatatctgtttttataatttcatttcttaccacaggaatcaacttcatgaacgcaaacagacttgtgattctatgaataaagttgattaagtcatcctgcctttccaagattcgcaagatcaaatcttttcttgcccattcttccccaaaaatctgcgtcagcttctgtaagttgttcactgctgcttctctgatactgtatactggatcatctaaccaacccatacatagttgacccagtccttcgtcgaagaaggacactcctagttgctcagccaataatggaatctgctcaattatggcaaggcgcactcgccactgtttgtcttgagcaagactggtaatggcaggtagtagggagttgcttaatctctcaattccaatcacttcattcacaacttgcaaatttgagataatattcagacgcacctcagagaagacgtcattgagcatgtgtaagaaaataggtagtaagtgctcaatggtggcttcatttcctaaataaggtgctaaaccagtaatctgggatgccagtgcagcccttaccacttctgattcgtcttctgagagactgttaacacaagggatgatctccttgattattatgtctttgttggcgtcaggttgtaagccatgattacctgtctcacttacgagtctgacgtaacctggtaattgttcactgatcgcttttctgacttctggctcgtgatctttcataagtccggcaaactcgccaatcaagctcagggaaatctggtcatcgtggaaagcttctactaacttttcaaatctattggcgatcatgtatttaactctccaacttgggtcattaatcaaattgagaacgttctgcaataacgcctcatggtgtgtcttgttaccaatcttatgaagaaactctagcatgcagataagaacttcaacggacaaaaacttgacagaatcctggtgatccactattaggacttgaaacatttcgtagatgatattccaattgaactcatcgttatcaacgttagcgaacttatctgaaagttgatcaacaatttctggaagatgagtagccgaggatttccttaccagagggatttcgtgttttatcagagaaaagtacaaattcaacaaatttttacgtttctctgaatcgaccctggccacaatgcctttgaaaagaccagttgaagcaacacaagaactgaaccattggtcttttgcaagtttctccactaaggggacaaactcagaatcgatctgagcgtcacttagggtctcaccaattaagttgagcgactcgacggccttatccctaacaacaggttcttcaacagagctgattttttccaaaatgggtagcagcagtaccgcatactggggccctccaatcagagggacgaacttcccaagttcttcggcaatgatgcagatcacctcatcttcatcgtcggtaacaacttcatctaggtactgaagtaactcgctcctggttcgttctggtcccaaagcaatggcgatggtgtctagtctcttcattgcttgtacacgactggcaacgtcatcataacgcaattcatccatcaatagggcgatgggataaaggtcttggttgttttcagccatgttgctttttggagtagagaacgatatgtggttttcttccattttgaggggcgcgcagaggatgtttgttgccctagaaggaagaatcgagggtgaggtggaagggagtaacgaaacggaatctacttgaactgggcgagaaggccgtgtacatcgaacctacgctcgcagtattcctatactatggtgaaattatttcttattcatcaaagtggttgaacaacaacagaataagttcactgccttggaaatcctcaatggacgatttgcagacatgaattgatgaggcaccaaaatgtaagattacctgatctacctgttccacatggaaatataattactaattataaacatggaatagtaagctgatacagggaaggaaaaaggtgttctttcggttgcggccatatctagcagaaagcaccgtttcccgtccgatcaaccgtagttaagctgctaagagcctgaccgagtagtgtagtgggagaccatacgcgaaactcaggtgctgcaatctcgttttatttttggacacagttttgcttaactaatccgggaagctgggcccgttgaaatgatgtagtaaccagctaacctcaagcagcctccatgaatcacctagtgtaacttgctcagtagtaacattctgggctccatgctcaatatgtttttaattgtgctataaaccattagatattatctcattagaaggtataaacggtatgctataagtttgaactatgccctgaaataccagtaaacgattcttgttctccagttttggcagtaagttgcgattagctattggtacgaagatcccaaattaaatatagctaatcttgaatgccattcggaaagtatccaagattttggcaagaagaacccatagtgagactctcaaacgcttcaattgagccattaggttggacttggatgttgacaacttttgcacaaacaaaagtaatgaaatgatgaagcacgatgcaaccaatggtcttatgaaacgttgcatttgaagaatccaatgtacttgtggggtattcgaaacagagtatggtgggaaaaggagtcttttcaacttatctaacaacgacacttgacggggagtagacgaaggtctctggagtttcttgtcgtcctgcgactttggacccatcggacgggacacttgacgggtttgtttcgctgtatcattacctggtttcttggagaagaaatccttcttgaaatgcttatggtttctttctctatctaataactccttctcacgcagcagctcggcttctttgaccttgtgaagatgctcgtccaatagtgaagagtacctcagaactcgctgggcatcggaagaaaaaatccgagcaataagttcttttgctctgggtatttgattcatctgggaaagcacatgaaccaaataaaactcaacaacccgttcaagagatagtaatcgtctatcttgaacagaaatgctagcatccatagggccaggcagttggtttatatggaaaggttgagcgaagacgtcgttcttcagtagataggtttccatttgttcatctagattaaccagagggaacttgttactaagttcgataataaaacacatgagagctagttctggatcaatcaaatggtagttgtgattgtaaacttgtacaatctgacgaaaaataaccccctcctgaaaaatcgtatggatctcctcatataaaccatttcccacagaattttggtcttctttgagtagcaagtcaatcaacgacaaataaagtttgtagatgttggagactagttcatcctgggaggcttcttccactgacatctcagaagatccaatgacatgaatgtcatttagatccagttgtgaaatcaaagaggttaccaaagtccatgatttggcaaagttcttgttcagatactgtcttatagccagctgatagttgttattcaaacggttttggagaagctctggccccaagtcactagaattattggcaaccgttgagttggatggaagatcctgaggaaatgcttgggccttaacaggcccataagaactcactctactgctaggagatacattagagacaccttggttccccgtataggccacctgagacattgctagaatgattgtcgagtttgcttttaggctaaaagaaggcgagcgagcgaatatctggggacgattaggaaatgacggtttgtggggagggctggatgttggatgtcgaatacggaggcttcccatagggaggcaattagttgtccttgtggaatcaaaagagcacaagaaacctgtgattgaaagtctgggctgtctggggttggcaagaaaatcataaagtttatatagtacatttgttagttgcttctttgaatgacaccttgatctacatgttgttcttcccagttcccaccgcgaagtttctctaactctcaatctctctttccccacttgataatccaaagaaatgtcagctgaaaagcgtttgttacaggagtataggtctatcctaaaggaacaaagacaaaaaggatcggcatccactttatcctcaaatggaattttggatttgaaaccggtttcagaggataatttctacaagtggactgcgaagctgaaaggcccaaccgatactggttaccaggatgccttttgggagcttcagattgacattccttccaactatcctacccaaccgcctaagttcacatttatagtctctgatgatatccctcgtaatagaaggcaaaggcagaccaatcaaattcaggatgacgacgaatttgaaggggctgagaaggaagttttaaggcattgttatagaatgcctcatccaaatattgccttcaacacaggagaaatctgtctggacattttgcaggccaaatggacgccagcttggacacttagtagtgctttgacagccattgttctcctgttgaacgacccagaaccactgtccccgctagacattgatatggctaacctaatgaaaatcaacgatttgaaggcttataactcattgatcgaatactacgtgggtcgatacagtatcgaagaggaggtgtatatattgaattagttaatgctatttgaatccgaaaaattcctcaatgtcatcaatttcaagttgttttttggtaccattctttgcgtcaccaatgactcttgtataactaagtaatcgcttcttctttgcttcaagctccgactcttctagctcaattttctttaccacgattaagtcatcccgatagaattcatctccaggtttgttggaacactgataaggctttagcttctccaagtaactgagaggaagattaaataactctgtgttatgctgttgggtgttgaggatggaattagtgaaaatcgatgtatatggcacaaaatgctggtccttgctaaaataggggttgtagttatcagttcttgagctggtcacttggtttctcagccgattcctcgacaccttaaattcttttaggctgtctagaattgaacttgattttctttttggagttaggagggcagctggagcagtttgggatcctgatgatgtaccatgtgtggatgcggtcaagttttttgcaactggcatttgtaagggtctgtatccattcatcaatgaatccagcatcaatgagttgtggttgatattactagttgagggcactctgggtaaaagactgatgtatctcttcggggtcttctttggaggggttagatcggtggttctttgaactactttcttgttcttagcgggggcggcatccttgcttctaaaaccggaaacttgttcaaaattggcagaggatgtctctacgttatcaccatcttgtggctcagtggcctcggcagcagcagcagcagcagatgaggaaaaccgtgccccaattccagagaccttcacccttgttgctgggtagggtcttcccatcataatccttgagcgtagcattgtatgttataagcaatcaacgggggagataggagcgattaacggatatgatatgaaatcgacagtctgattcgtaggattgagaagaatattattaggcacaacaaactcctttggcttttaaaatgctcttaaaacaaaagggatcctgggagggaaagaatgtttggtgagtagaaagttaaaagactcatatactctatggctccagaacacacgcgagcgaggaggcagggatggtgactttgatcacgagccctgttgtgattttttatctaatccatctgtcgatcacgtgctgatatacttttcagagtgttaacggatttaggtacgtgctgtgtttgagacgagaaaaggttgaggtttcaagttgcggaatggtggaaggtggtaataggctgatatgacttgtttaatgagcggtggtcgaatatcggactttttggtatgactttggcacagaaactataaaatacaatttgtggatatttttgtaggcacccaaccgttaattaagacaatatgctaactgtgacaaaacaatgcaggagacaaactttttttttttttccacgtaaattaaatcatagtaaattttggttgacattatctccggatcttgacatcttcagtgagtaccgaatcatactacgacttaataccttcctcgcgccaaattctttccatgctgaattccaaaaaagaaaagagcgcctttgaacaatgctgatcagtgaatgcttcgcctgtggctctgcttttccagtgctttcttcactcaaccccatttaagtaactccgatctcatccaaacagcatccgccatcggcagcttcctgctttgcatgtgtcgcgcatcgatgagctgatattatcaacccacactcattactggttggtatagttgcaacctcggctacaagagcacaccattccacaaacaccagggtaatttaaagaatagttgaatttctagaatattctgaatgttccgtggttactataattgtgtttgagttcttcctgtaacccagtttttccttagtttattcccctcccgattcccaacccttccctccactttggtagtacactccctccaaatagattgcgataggttgcaaattgacatacacacatacacaccaactttataacaagggatttatttgagcattcccatttctttcgtccttttgttcccacaaaaccgaaaccatccccaactcatcaaaagatccgaaccgatctttcatttgaagcagtctccagtggatttgtattacctgtttttcagtacaagttctctctgttcataacctcttcgacaaagttctaagtgatcggttaggttaaagactattgtctcagtttctcggtccctcaatccttcacaagccaccagcattgctatggaactaacgatcggttaactctggcattcgtacatcaaatatcattatgaatcaagaggtccccgataacccattccaattaccgacttcactatcatccgagtcctccgacaagaacacctcttctgctcctcctagaaggaggctgaagatcgtctcaagacgaaagtctgttgatgatagtgaacccatgtcgttatcatttctcaagaaaccggcaagaaataattccgtggatcagactcatgtcaacgaacaattagttcgacaaaacactttccagaaccgcaaaccatcacaaggttccgattcatctgatgacccaaatgcgggcactcaggctgataattcatccatacactcttcatctccaggatatctctccccgctagttcgaaaacgaagtggagaattggtcaagtcatctctcaaattaaaccatctaccacggcccaaatctctaccttcaacgcctactttcaagcaagtccacttcaattttggaaatgacatggtggatgtccgctactttgatgaaaaggagagacccaccgctgtgtccgctactagttcaccgagcatcaacaagacgtatcattacgaaaacttcaacggcctatttgatcaagaaactcttaattggaagttgaataataacaatttaaatggtaggggcaaagctattttttctgcatattacggtgagagtgacagcgacgataacgacgacgagatagatccggacgacgaaagcgataccgaagaccttaaggtcttcagaaagtattacgatcttgaactagacaattttccaaagttttcatattccgataacgttgataaagaaagttcagttttcgttgaacgattattcctgagccctgataagcgttatcttatgggacaaatcgctgttaagaatctcagttatgagaaaacagtggcagtcaaatatactgttgacgggtggaaaactcgtgacagcgtccttgccttttatgttccagatttaccaagacgattgcgtaaggctggatatgatagattcatttttaaagtcaccgtcgcaactctgcttcgtaagtttaactttgcaattgctcaagacggttcgaccgtcaccatagagttatgtgtcaactattctacagctggctgtgaatattgggacaacaattctaatagaaattacattgtcaagtttgttaagcacgcaacccagaccaagaaattaccaaagcctcccccagactcaaaatttagaagatctagaaactatgcgaacaatggagcggtggaacatgcgactggtgctaagagtggcaaggttacatcacctttgaacgacgagaatatgagttacgatgaaacgtttaccctttcctcattgccgcatactaaatcgttggcaagttccccaggaactcctagaattgaatttaaaatgaacaacacgcccaattttaatgatttgcaaagttcttcgagttctcctggagctactcgagaatatcctgagttagatatcacctccaagttgaaggataccaatttgaatggacttaaagaaacattaaaaacattcccagctttttgatcgacccgaaggcttctctgcttgatcctacatcatctccaagggaaataggtaatgtaacaattggggaaggaggctttgaaacaacaaattcggcgaatgatttggattctaaagccgccagcgctgaccaatctaatgatgcagcatctagcactgcccctgcgccgcacgccacaacttcaaaaggcaaagagtttgattctgaaagctacaagaagcttttggaaagttactgttttttcaagagcagtactcctgtttcttcatttctgggtgagcaaatcaatacaccgttcaagaaggatgacttatgatttgtatttatagttgaaaaaactatgtcgttttacctgtatgcatatataggcacgtaggacccttagccgtgtataacatgcaatattattcgggttttgggtttattatgcatagttttgtttttccgagggtcaggtgatgcatcaagtaatcggccctcacggatttcaagtttagaggctttcggaaagtctcggcaaaatatagcaaaaaaaataggaccctatttaagctgatcaaaacacccagctaatttggaactgttgttgatttttttgtcaatagtattattcttgccatccgtcatcgtctagaatttttttttctgttatgaccagtataccaacatatacagttgatacgcaagatcttgtctcacagtatgctaccctgagtagcatatatgcttcagctaccgaagctcttcttaccgtgtcaaaaaaatatgaaaccgtatcactacttcggcaattggatatgttatcagtctctgaggagtatctgaacaatgaatacatttatgccactgctaccgagtcctctgtgagagcctctgctgcgtccgtaatcgcagaggcaacggcctactttcaagattatcaagatgacttaagtgtgtacggaatgactccaagttacggtggtaacatggcactagcaattgtcatgggtattttttttgttttgagtaccggtctaggtctatactataagcaatggtggtttggtacatgttttttctttggatgcggtttagaatttgccggttatgttggacgaacagtctcagccaaggatcctgttttagtggaccccttcttggaccaaattatttcacttactctagccccagctttcatcatgggtggtatttactacatgttggctaaactgtgttctattttcggtgaggggcattcgaaactgaaacccatgtcttatgcgaaaatatttattatttgtgatcttgtgtcgattatcatccaagccgtgggcggaggtatggctgctagtgctgctgcgaattatgagaatgcggacacaggaacccacatcatggttgctggtttggcattccaagttgcatctatgacacttttcctctacttttggttcgacatgtgttactctatttacaaagtctacagaacgtccgagaacccagatgacgagttcaatgatgagttcaaggatatcagacaaagacctatgttcaatactttcccagtggctataaccttgtccactttgttcgtttacgttcggtgtatatacagagtggccgagttgtctgaaggttggagaggccatttgattactgaggagatatattttttgatcctggattctttaatgatgtgcttggcaatagttatcatgcttatatacttccctggtttcgtgtttggaaaagactcccatattcctgttaaaggttttagattaagcaggaagaagaaagaggaaactcctcaaccagatggagataagctgctcacggataacaatgaacaatcagccaccgacaaggatagtgtttagtaacttatattagattctaatactattgcacattttgcattctatacagatgctggctcctgggattccctcgtagatgtttcctccgaattcgcttccaatcgatctataggaccattcttgacgaactcttcaaagctaggatatttaacaaaatccaataacaggaagcttccagagagaagtaacgatagtttcatggcttcttggtactctaaataagttttagcaagtacaatgaacctttgcatagagctcttgacatcttttttgaacttagtgacatcctcgtaatcttgctcaaaaaacttgtaaacttctggtcccgtttgtttggagatattaataatcagttcagcaacatatgggaacagcaagtcgttggaaagtttagtttggataagttgccttaaaatgaaataacatcggatacaatggataacgaatgaagagcgatctaaagtatcagctggaggagtgggctttccaagattcttttgcttttcaatttgctccttcagtttgcggataaatggtatatcttcatcagaaactactgaactattggatatgtctgtaatcgtatgatacaacctgtaaagttcaacagctttatatgaagggacctctagagtatgatagtatctcgtaactacctcctcaacaatcttcagatgaaacacatccactaagttgggaaaagatgggtcataaaaaactttgatggtatcttccagatttacatccttttgctcccgaacgtactttgtcaagctgtgttcaaattcttcgtaattcttgttatctaaaggacttaatacctcatcagggatttgcagtcccgtttgatcaagaagcgcatgtgtttttgaaacatactcagcagtcaaacttgcagcctctatgttctttgttacctcttggtcgtttgtgactgcacttgtctcagcttcagaataagactcgacagttgggagatatggacgattagaaagaacatacacttctcttgcttcttcgttaaatccaatccaaggtaagactaacatttgtattgagagtttgtactcgggatcattgattctaatgattcctgatttatgcaagctaagaaataccaaacaagtgagtgtcatcaagttttctttcgctttgatactcaaaaatgagtctgaagtattattggccactgtttctgagctatgagtttcttgtgcagaatgttcagctattgtttgattgtcatctgtcctctggtcattgtcaaaggttactgttagtttatctataaacaagcgcaataacatatttcgctcaaactcagatagttcaagaggcccctctctagaaaagtggaacgtttcggggttaatgtctttctcttcctcaaaatcccaattgcctctgcgtgaagttagaagtaagtggaagtattcgaccaattgtagttccaactgcctttgagacagaaaccatataaggacccttctataaccaggggccataaaaagttcatcaataattgctaataacgtatcggattcagtgtcaaacagtttcttccaaagctgaggttctgaaatcagctcatagaccttatcgggtgtgatttctgatgcctttttcccatcgggtttagattcttctattgcctgtcgttgttcataaggtaaacagaatagttctgactgagtatcaagctcatccttgaccgattttgccacggtatccaccaatttctgtttttctttttcagtaacgtctcgttcgttagtgagacgttttattatatctacaaactcataccaggatgaacagaactgtgaaggatcctgtagaagttttcgaaaacgggaagaaaatagcatgtttcgacctctcacaatatctctccaatcttcgtcactgttttcgattggcatatccccactaggaggagatgtcccttctttttgatgattcaagaattctttattattagtcactgtgatttccttgtcgagttcagaatccatgtcatccatatcaattatttcattttcatattctgcagagtctaatccaaagtcacagttgcaatcaggatgaagttccatgatctcgacatcttcatcatcatcgccctctccaatatcagaacgactattcctggattcctgatctgattcattttgtacaggctcccgtggttggaagatgtgacgaacaaggtcgtccaaactatctgccaattccaatttattcataaagtgtttagcacattcttcggttaaacccagcttcaacaaaattgaaaagtactctggaaaattaatgtttaaggctcccgttaaaatacctctaccgtaagggttcaaaaaattagttaacgactcatgcttgaaatcatgaatagttgcgtatcgtgatttgttaagtatcgcagcagccgtggcacgtaccgcagagctccactttaaaatgtcagcgaagacttctggatattcggcgtattgactctctctggactcaaagggtactggagacccaaaagcgagaacagttctctgcaagttccatacattgaaataaaaaaatgtgaatggatctggcgggtcttcgagtcgggaaagcttatctatcaaaactaagcatatcactagcatagaatacaatagtttcaattgatagtagtcctggggttcttgatcgttactggtaagcaatggatccggaagccatttgagcgaaaaattcgtctttactgggggagactcatctctagggatgaattccagcgaagactcatcagaataatgcagtttggctagaatcgactcagcaattcgacacacattgaaggccatggaaaatgctggaaggtctatgtctgaagacctgtatgtagggaagacaagtgctaacacaatattggaaactaaatcgaccgataagatctgcctattatcgattccagtatcaaatggtttagtataatcatcacacattgtaataagtgtatcaaacaacagcttcaactgttttcttgtggtttcattaatgggaggtttctccactgccaaatactcataaatggagttatgcaatttgttgacatctaaactattgtgctcattatgcttgaagtataaaccctcgttcaacattaaaggggatttgacccattcacctttggaagcaatttcgtcaacagtcagctttttcagatcatcttcagagtcaagttcatattcgtattcatacatatattcatccgtaattggatcttctaattgatttgcatcaacgcctttaccactcggggcaactgttggtttactaattttggaagatattgtgtcaaattttgggagtcagtattctgaaatcaggaaagtcagtgttcaaatgtttggatgagctatggttacacaacgttaggtaggcagagagggtataagattatccagacctactatggtgaaactctgatttttcctggtagattgtagtagtctactaccgtattggatttttgtcgctgatattttccaattcttttgccccagctcaggtgcgatgagtagtgtactggaagggtgtgtcgaagaacgaacccttccgccactgggagcgattagcagtattttgcgaggttgcacaaaccgaagccgagagatgatgatctgttaggtacactactgattagcacagcctataataggagtgacgtgagtatgaccgaaaccttctttttatctgtcaactaggtttacttgcaatacttgatgtcgtctgctttaattaatagatcacttaccactatcaggacggaactagacttccttagagagtcggaagtcatctctgaaggtctctttcagcaaattattgatcagctacctgaaaagcacactcccggaatggccgctgcatcgtctatcaagactgaatctgtcaaacaggacaaatgggaacctcctaaggaacctcctaaagaggaaaatagtgtccctacgcctgctcctagcgtttcagctgctccaccttatcccaccagtttagaatttgccgaggctctgtacgattacacaccacaagagaaagaagacttagcactccgcgtaggggacaagattgaagttactgataaattgtcatctgattggtggcgtggaaaagttaatggcactgaaggtatctttcccgcaaattatgtcaaacttttgggctctagaccctctcactcacctcctccagtggcacaagctcaacgttatgaatatgaacctcctttgcaatctcagccttcaggagctccatctaccaaatatgactacccggttcaacaaacacaacaatatcctggacagaattttgggtctcctcagccgtaccctcaacaaatagtccagacccaacccatggtagtccaacaacccgagcaggctcaaagtggacatggatcacaagatttcaatcgtcatgccaaaaagtttggctctaagttaggtaatgcagctatcttcggtgcaggtgctacaattggtagtaatatcgttaacagcatcttttaaagctacttgaaataattgccatacgtacttaacattctttgtaccgttttagtttttatggaatatgattgacttggggcgcttaagtctctaatatctcttaaccactcctgtctcctggacgtcggaatgaaatagatcccactttttctgaggacaagaatttccatcagtaaagttccatatcgttcataaataacgttttgcggttctggttctgaatcatcgaaattgagaatcctttgaatggtattgaagctggacaaaacctctgttctcttgctcacatttagcttatgcaaatatccagttctggcatagctattgatgagaccaactaaccaatatacaataagaatactgggagaggctgcaactactccaaatacaagttcttgagatttcagtaatttgtcaattccattcattgcagtggcaccatcgacctttgttttttgaatctgaattaggagattacggaccaggtctcccataacaatccccttgaatggagacttgagttcactttcataatctctcattataggggtcaagtctcccttcttgaccatctctgataagttctctctgtacgtagtaagagacgttccaggaggaagcttcgatttttccaaagcgtaatcaatgaccatcctttcaagagaatctaaatcagcatctaaagaagcttgtgtagtgatggcgattcgggaattatcatcatgtttaactgtagccaaaatgttattcaatggactgagtatccaattgttccaaaatccaacgaccgtgtcaactagattggtctggatccatttagctatcaaccttcgattgtgtataatgttcattgatgtcgagggaacatataagaccagcaataataaaggaatccaatatctaatgataaacttgggtcttccgttaagtctcttgatgtctctaatgttatgatcgcaatccggcaaaagcttggaagaaagactatacaggtcttgcaacagaggagaaggtccgttgttccgttcgccatacaaaaatatgtttaatagatggttaatagactcgcccgaccctttgacaagatttctcaactgggtatctagcaactcatcgtcttctaattgcaccgtaagagaagggatttgtggagtcagagtcgagaggtatcccaatttctgagcattttcctttcgtaagtctaccaacgccttccttttcgaataaagctcttctttcaaggacaaaagcggagcttccaaaataatcttggtgtatcgaagaatatctttggtactataatataatgatttcttgggtaaaccaacggacaatattgaattggaagctacattcaagaggaaaacactaggagattcaattgtcttgatacttgatttcatggtttgcagaatcataaaggtccatttggcaatctgtctataccatggttgaacaaccggaggcaaccaggtagggatcgcaacttgcaactcgtcataactttcaactctcttggcaacttcgtcgtacagaaatcttgtataactccaagttctttcaggtaatgattgacaaaaaattgcagcgattttatagttggaagaaaggttatcgtcgtaatactcaatgtcatcgtacagaggcatggtacgacctagtaaggtatcacttacaagaagagtcaggattagagtgagataaacaattatcaagtcctccaatctaccaataacgtccacctcattcttcaattttgcgctaaggtcagagtattcttcagtggctactattgattcatagatcgacccattttggaatggctcgagaatggtagcaattttggcaaatgagaccgaaccgatattgaccacagactctgcggttttgtctttgttttgaaggttcacctggtgtatcttcagaggatcagccaaagaataaacttcgctgaaagacttttgaataatagcaagctgagttaatattcttgaagggatctgcaagttatcagactcaggaccattgatatccaacgaattaacctgcgccaataccggattggtgtaagcactcaaactgttcaaattaatttgaacagcatcactgatgctactcctgatcatgattgcggatctcaaagtgtaagttgctggcaggtctgttactccgtaaattgtaaattgaaagggccaatcgcgggtagttagaatcttgatggggtggataagtaattggactatgctgatcgtatagtttgtatcatactggactctataatgctactccagtgattgtgtatgagctgatcagtacgtaaagggtcaggattaccccccaacacatagggatccaggttgacatggagaaggcaccagctctataaacttgcccaattagtactccaacgactgagccggcaactacagcgtgaaaagctgcaattatcagatagaccacaactatccatattgaaaacgccagtttccgatgagttatcgcagcccaaattcctgctgctccataaaacacaactaggaatataagcgaccaataaagagtaaacttccatatatcaaacatatggtaaagcttcgcatcttcaaagttgtatagcgttggccagtacaacgaaggaaagataggcacctgataaccataaggaatgtgctgttgccaaacagatatatacattcaaaggtgtagaggatacagaatgacaatagagcatctagtgcgaaatgttgtattactatattacataatcattaaagtgggccattaattgttcagaacatgttggaggagttttaacatgaagattctcccgcttattgcgttgatagctacattttgaagatccaaatttataggatgtcccggcaaaacacaaagcagtcgggataccagtagtgctgtaatttgggttgtgattactccacaatcactgccattgagttgttgaggacaatgtgtattttcaacgagttgtattcgcctgtttagcagagtggacagcttagacacaagcgcaacagactctgtgagattggcattctctaatgagtcatagaggaaacatttgttatcgtgaacagctacaactaaaagacaccaatgggatccaccttcagccatttccagatcatcattgtcgttcagaggaaggaatataaagccagacttatccaacggtgggagaaaatcctggatatcttttggagttgaatgtgccagcaaaaaaaccatagaaggtcggaggagtattatttgagaattgaccatcttctttgatgaaaattgaagcttgtcgctcaaacaacgggtaatgtaaaatctttcaatgtactcgtagataaacgagacgttattatcgttcaaccattcgtcatcagctaggttgttcagatcttcttcatagagagatacatcgtagaatgtgtggggactcccatcagaattggaaagttcagaccgaacagatttgagtaaggagttcagtgtacttaagttagaaggttgtgaaatggcagatcgttccgtggattgatcatttttggctgtgcgtctttgttgacgttttgtctttgctttagttggcttcttttgctttttgttggctcttttcctgttgcctatctcttgttgtgaacgatgattctccccttcgtcacctaaagcaagatactgagtatctgcggttaaatcttgcgcccaatccggttgatcgaacgattggtagccgtcatcgtcgtcattaatggtattgacatttctcaccttgaacaattggtcaaacccattggttacaaaggtcgactcgggaaacatccattgtttactctcttcgtcactctcttcatcatctccactgtagattacaaaaccctttctggaatgaaatcgagttttcaacatgtaggaatgtcggatcggcacccggctggaaaaattaaagagagattatgtaataaatttcagaacgcgcgaatttcttagtaaaattttctcagttgggaaagtttcgattactcttttgggaacgaactccgttttggtcgagtttgttcccctagtaatctatcatgtcatacatggaagctttcggaaaaggcatcacctattgaaaaataaaaatgacgagcttgacactcatcaaacccttccaagccaatcgtctcaaagtgttcaaaaagctgccactctccggccccttctttttttccttttttttttttccttcctcctgtgtctcaacacatcttgccccatcccatcgtcctccctcccatcccttgccttccatccctcccccaaccgccatagcggccaccttatgccagtagcggaccgacgtacgctaaactattgtctcgtgcggcttatttggcctaatccggtaattcgagtgttgtgagttcatatgtaattacccttttcatctgtaggagaatctaaatagcaaacattgtgccccatgatatataatgcctagtttggagctgtaattagttttttctcttttcttccccaatttgtgtctttacctttcataaagtttatttttgttttgaaaacttatcatggctctatcaattggtgatctttctttaagaaccgtcaactttgtcttcctggtgatcatcctgggtctttccggatccttggccgctaccgcagacaacaacaacccccaagtcaatttcgtcgttttcgccgccgcttggggtctgttgacttccaccttctacggaattgctgcttacttcatttcagctttggcatggccaattctgttggcaacgttcgactttttgaactttgtcttcctcttctcaggtgcaaccgctttagccgtagctatccgtactcacagctgttctaaccagtcttatttggacagcaatggcgtcactcaaggctcctccgacagatgcagaaaggcccaggctaccgttgccttctcctacttttcattcttcgtcttcacagctgccctgttcttctctgttttggcagttttcaagaacggtttattcggtagctccatttcaagaggtactcctcgtaccggtgtcccaaccatgtcacaagtttagaatgttttgaaccacactgcacccttcttcccttttgtttttctttagtcctgattgtttcatgttccgtttgagtatacccattgaacttgattctacgccttttatggcagaagcaaaaaaattaaaagttacaaaaatgctaatcaactaaaccaagagactcctggacttccatcccgtctggaacgatgaatttctccatccaacgctgtgtttaatatgtattctaataacaagttgtacatgtattatatataaatatttacatcggcctttcttcatatctttgaaagcatttcccttttgactgctctttcctacttatcgtccaacactcaatagaagcgaattgctggatcctgctgctgcctcacctcctttggctcctccaggaagataagttacgttgggtgatccagccagagttgcggcaatctccttagatgcctcaattctacgaatcaacaacagaccatctcctgccttttctaaagccttggagatatgctcggcagcttcagcttctccctcagctctaataacggaagcctgtctttcctgttcagccttctcaacgagatacttggctctttcagcatcttgctgtgcaatctgtttctgttcgacagctttggtgaactcacgtccaaatgtcatgtgtgtaatggaaacgtcctccagcctaatgtggaactcgttggctcttgctgccaattcttgtcgaattctagcggaaacaatttctcgttgggtaatcagttcagcagcatcgaattgagctacaatggtctttaagacttcgtttccaatggatggcaaaattctttcatcataatccagacccagagattggtatatagagggtaatctctgaacatctggtcggtgcaaaactcttaacgttaaagacactgtttgcaaatccttggatcctgtggtggtagcaatgttccttggttttgtacgaacatcaaaaataactgccttctgtaaccagggaatgaggaagtgggttccttctccaatgacatcctgtctaacacctgaataacgatcaaaaatcaccgctctggttcctcctttgacgtcgtacagtgaatactgggcggcactgagggcaattccagctgggatggcaatttctttaactcagttagtgacacttgcttctatttgcggttcataacatgtacctagtacttacttgatataaaatctgctactctagacatgatgactgatgcctcttttacttgacttagtaggtttggttctggtttgccttccaaaaatgcggtgaacggcgcgatgtggtagtgtacgaagaaagaccatcaagcgtgtactaatcaacatcatgccattctattcaggtatacttaattctcttcatcgtcttcatccttttcaactagaccagaatcatgtagtaactggtcaatctgttctggtttccatatacggtgcacaatgtttccgttggagtttttagtaatggtagcaaactcaatcttttcactagtcagcgacgaactgtccatcgttttactcaacaccttaagtgcgagattctttgcctcctcaaggtttatatcattcttgtagtcttgcttcagaagagtttgggcactagagttgttggctcccacactggtggccttccaaccagagtaattacctgatggattggatgtatacagttggaatccatatctttcatcgtaccctgcgtagatgaatgacacaccgaatggtctcagaccaccatgttgcgtgtaaccttgcttgatgtcacacagatgacgcaccaacatttcacaagggatgttctcattgtatgtctttagataaccttgtgctgttattctgacattgttgatcagaattccagcatctgctgtcatacctgctactgcacagatcatattatcattcaaaatatacattttctcagcagaagagtcctgttcaagcagtttactggtgaccttcttctcagctgctaaaacaacaccgtcgttggccaaaactccaattgcagttccagcatgtgaaatggcctcaagggcatactcaacttgataaagacgaccctcaggagagaagatcgtcgttctactatcgtatcttctggacatcttgtgagggcgttggttaacagtgctatctttcgccacttctcgatattgagagagttgaaggtagtgcaccgattcaatatcaaattggctcccagagatgctcataatagaggaaagcaccatgtccgtgaggagtgggtactgtaaaccaggtggtaatgctacaaagatcaggaaggtagttgccgatgaggttggggtttcaaaatttattttctgtcctccgaatatggactggaaggtgattgtaacgagtaccggtcgaaagttttttcataatgataaaactaatcagtctgtgtggcagatcgacgatgatgatgtgaatcaacaattagataaaatgaataaggatgaaattcttctgttaattggtaaagccagaggattgatagttaaagagaaagaagaccgtcaaaagaagtcacatatggaaaaaccgatagaccaagaaaagaaagtagaatccgaaaaaaaggtcttcaaagaagttaattcggctaattctcctgccaatgtactgggattgcaatattctgattctgagtcagatgaggactcagattcagtttcacatgaagacaagtctattaatactgatcaagataaatcagggtctaatcccaactccgaatcggtatctttggaagaaggacttggtatggatatttctaatctttccgattttagtctgtcagataatgagaccccagctgctaaggaagagtcagtgtcactttttaagactctgttagatgatgcccagttagatcccttcagtacatgggaaatagaatcggtaaaaatcatccatgatccaagatatttggagctggatactgacaatgataggagtagtgcatttagtcagtggtcaagagaaaaagttgtcggaaagatcagtcaaaccgatgaagtagaaatctctgacgatgtctatcagtcgtttgcccagtttataaaggaaaagttagtcgtcacagttgccaacaaacatactttgaagaagctttattttgcggagtttaaacgaaaatatcgcaaggacccctcgtatcagcgtctgctgcagcatttgtccgaaaaagaactagaatcattttacagacagtttgttccttttgaagaaaaaataataaacctgccacaagattcaaaaagaaagcttttgcttgatataactttcaattcagccccactattaggaaaagtcaaacagtttttaaaaacgaatccaactagtgacctatttgagcaactgcaaggtcaatcaccgcaccagacttatatcgaactactcaagaattttcaactcagtgaccagttcatagcaaaaaacatagttcccttacacgggttatccaatcaggatcaattgtctctaaaagtttccattttattggaagctctacaactgcaggctcaaaaactgaagagataataccttttatactacaactctactcagcctataatacatatacgacgaaccagtctaacagccgccagtcagattcgtagtagggaaagtgtagcctgccatcttccaacttgtaaggttgacgttttgatacgcgttactgtgttgttggatgtagtcgtacgttgggtgatctgctggatcgcatcctacgttaatggcacctggtggctggtacactcgcacatagtcaattttcatggtaaccggaaagttgagcgacggccagtcaatataagcccagttattagataatcccaggttcataataatagacatgggttctgtggatattggtctccaaccaatgttaccatcaggatggaatgcattggcatggactgtaaaagtaggatcatcaccgacaaaccatcggatgtatccattacttccatacgtatactcaaacgcgtaattctggaaatgaggatcttctgccctctcgtaccatgaatgattcagtgtggtcacaccagaaacggcttgttggaaaggacctccagcatacgtattcattagggtaacactttcgttgtgaatctccacaaactcgtaatcaggtatataccaaatgtcgaagggagcaagctggacggattgggagacgacaccaactttctcagtgggactgatgtcacccattgcagcttctacaatatcaatttctggagcacctcttccatgtcccctattaggatgttcctgacccctgcaagtacaggcgttcagtttttgaccaggtaaaaaggaaataccatcagcggacgattggttcgccgtaataccggaatcacaggtatcataagagtaaggccacacaccttcagtggttgccaggtaaccaggtcttgccaaatttcccaaagtccatataccaggccatagaccagagatgtcaccgtagccgggaagcatagccgagacctctataataccctgagtaaagcacatttggttccaagagtgtagcatcgcagagcggtagttcagattgtgatttctgtaggtatcaagacggatgttcagtgcaccttcagaggtgattgcagcatcgggatcataccattccaaatcttttgtggcatcgtagtgcaaatctgccccataccaatactgatcctcaccttcatagaaagttcttccttcaatattgaactcgtcgctgaaaactaacgtccattcgtcaccgtctttgcttactcttgttttcgcatcttctggagtatcagggtctaccaaatcggtcctgatagctgagagttgtggataagtgtagtctgttaacaaaacataagtctctaactgatgtctgtgtcctgtgacaccagtatatgtgagcaagggcaggagaatcaacaacagcagaacaccgatagccaaagccaagatagcaaagaaaccccaaaaggatttcctgtccatgcttttcatatcattgataaatctgtgcttctcatactcggcatcggcgatgggatctggattgtgaatatggtcatcttcttccttatcgtctatcgtgagaggaaatgaggaagcaggatagcctccaaaaggagagaagtccgtgtcaaccaggaaggggttagatgatggatcgctagattgcgtcgagtcatcgctgttatttcttctatgcatcaacgaagctttggagtttaaagagttcatcgaggcaattcttgagtttgcaaccgatggatatctatcatattctggggccaacaatccatttgaagagttggaatgtgacatgttatagttattgttcgaaaacgacgacgacgagttctggtagggctctttgaagatttgctgctgttcgtccgaatgggaatcgttttcgaaactgcgcagttcatactcttgactgaagggattttgcaactcttgcggtgttgtttccggcgagttggaagacgagttggcattccctgaccgtgaagttaagtttctagtggacatttcaccgtaatactgctgcttcaaataagtaactggaatgaggatgaactaacgtcaacgagggatatgttttgaaagcactatttgtgatgatagttggggatctgatttcttgtgggccaaatttcgatggattctgcctaaaatacgtcgggtgtaaggtggaaaaaatgagtggaacctggaatgaaagagaagatcaatacgttcctgactttgagatggtttgtttgttgtgagcacaatccgattggaacttgaacctgttggtcagtttatttattgtcttttgcttccagaacaaaaatagttgagttagagaaaaagaaactgcctagttcttttgagagagtcgtgtattgttgatccaaggaggcagagcaagggtcgcgaaggaatacggtttttccaaatttagaataggtgggtctttcttacagcgcgtttctagatgccgcacgcattgtctgtatggcaacgggagctgacactgaacaccagcaggctagggtacgggtactggcacattggctcatttggttggttctatccagtcgtgggtgcacctgaagggcattccagagaacccaaaggaggctgtgtccgtgctatttcattgcaacgcagctttgtggcaattttacttaagttgcgccttggcaccttgggaccaattattttttatttccaaaaggaaggcattccgacgttgcataatctgttcagacaaagtttccatattacgtaacacactgtacgtttctcacaagacacgaatgattacctatccgcgggcgctcgtcaaaaagacgatcactccctgaatcccagtgaggtaaagatgtattttgtatggtcgcgcatacgcttatcactttcctatcaaacaccaacactccacgccatctctactctattataatatcacccccagctccatcctccgcggactctttcttcactgaatctctcacattgtcgattgaatgcataagaataacacgacatttttatcccgtgtttttggcatcaattcgagaaacatagacgtccacaacccgttgtttgctgatgatagtgtcattcccttatatgatcaaaaccagtcggcttactacgacaatgcctacagtgattactctagcgatgaagaggactccaaaccacgcacaagccggcagactgactccaaccttcatatgactgaccattccggagatgggaacgatccattcaaccaaatggacaactcatctcggttcagtaactccagctctttccattacaacaacacagatcaagaagacgacaatcctgagttgctgctgctacaggatgaagacagctctttaaataggaagaatctggacaactctgattttcaatcgtttgctaagaaaacgtttaatcagatccctaaaatcaagttccagctacccaaaaaagaagattatcccacttcacatcgacagccaccggatatcgaaaaccagaatgggactttgaagtcttctgtcaaaaaacaaattcatttcttggatccaatggataaggccctctggatgtggtcaaatgtctccaatctggacacatttctacatcaggtttacgactattatacgggaaatggattcaattgcatcatgatgaataagttcaccgaattgttcactgtagtatttattgtatggttattttcattcatgggtaactgcatagattacgataagttgatgaatgataggaatgtgtaccaattctcccaagtaaagattgacaaatgctactcaaagatcgggttcttccctcaaaaattgatctattggcttttcttcattggcctctgccttaaactttatcaaatctttttagactacttggtgctcaaagatatgaagttgttttttaacttgcttcttggattatccgatgatgagttgcaaactataagttggggcctagtggtcaagagaataatgatcctgcgagacaagaatattaatgcaatagtatcacagaatacagacctaacttcaagaaaaagaatgaatgcccatgatattgccaacagaattctaagaaaggaaaactatatgattgcaatgtacaataaatcaattttggacttggacatagagctacctttgattgggaaagtacagctattaaccaacacgttgcagtggaatttgaatattgctatctttgactacttctttgactccgaaacgggtcaaataaacttacccgctttgaaggaaagaaaccgtcacacaatttcaacagagctcaagaaaagattaattttttgtggaatcattaatattgttctggcaccaatattatccatctactttatcatgtattatttcctcaaatttttttacgattttaaaacgaatcctgcggatatctcttctagagagtactctccttacgctaggtggaagctgagagaatttaatgaactacctcacattttcaacagaaggctgaacatttccactgaaagttccaacaagtatatcaatcaatttcccaaagaaactacaacggctctactgaagttcatcatgttcatttctgggtctattgtgggagttttagtaattgtgaccattttagatccagaatttttcttaaactttgaactaactcccggcagaactgttcttttctatgtgtcaacgctgggggctattttcactatttgcaagaactcgattcctgatgatacattagtttttgatccagaagtgagtttaaggtatctttctcaatttacccattatcttcctcaagaatgggaagggaaataccacacagaggaagtcaaaaatgacttttgtaaactgtacacccttaagttatatttggtcggaaaagagatcctcagttggctcttcttgccttatatcctgtgttacaaactgccggagtgtgcagataccatatcagacttcttcagagaattcagtgttcatgttgatggattaggatatgtatgcacatttgcaatgtttcaattcaacaaccaacataacgagaatggaaatgcgaatgtacatcaaaatgggaatggtaatggaggcgttccatcggcaaagtctaagagcaaaaaagtaccgaatcctaatcggttcaccactaagccttccatgcgggatatggagaatgacgataagatgataaagtcttacatgtacttcttggagagttatggtaatgatgagattgttcaacatcagcaagcgctgaacaggtcactgatctactcaaccgagatatctccaactagcggggatgatttaaacgattctaatattctgggattacgccagagaaacgtggcaaccactggaaagcggcaaaatagtattggcaacgggttgatatacaacggacaaaataagcggttatccatcggtgaagctaaaactaatgtctattccaatcctattgcctcaactgtacttgataaagatcttcaatacaaactggctaactcatacatcttgaatggtatgccaggattaaatgaggccaatcaaccagcagatcgaaaaaatgaacgaaagtattccaatgattcaccaggagttatgaaattggtagataaaattagtcaacagcataaggcataatttgttttcattcatagatcttgaataataatgaagcattagtacccccgaatccaaaactattattgattgctgccttcaacttgttctccttgtttagtatttgactttgattctggacgtagttgaaaatgaactcggatttggagtctgactctgcacctcctggtgattcacaattcaatgtgggcggtagaatgttttctgatagggccaagacagtgaaaatggactctacagctcctgctgcccctagaagatgtccaatggcacctttggtacttgacactgctaattgggggttactcttctgaaacagtgcgttaatggccgaattttcagctctatctcctaataaggtggatgttgcatgcgcatttatataaccaatatcattgggaacaagccctgcctgtgtaatggcaaacctcatggctcttagggcaccgtttccgtcttctgggggtgaggttatatgatgagcgtctccagttagaccgtaacctgctatttcacagtaaatcttagcatttctatccagcgcatgttgcaactcttctagaaccaaaattcccgcaccctctcccatgacaaagccacctcttcctccatcaaaaggtctggatgcttttgtggggtcatcattaaatgctgtggaaagggatttggctctaccaaacgcagataacgcaaatggagtaattgaggcatcagtccccccagctaccataacatcacaataaccatctttaataaaccttgatgcatcgcctattgcatggtttccagtggcacaggctgtagaaacgctgtgatttggccctttaaatccgtattgaatggaaatgttaccagcagccatgttcgctagcattctgggaatgaaaagaggttgcatctttctatggccttttgaatgaaagcccactgcattatcgtacatatcctgtagtcctccaattcctgaaccaatgcaaacaccagtatcttcaaaatctgtctcagtaaagcattgccattgagcgtcttgtagggcctcttcagcgccttttagagcgtattgtataaaaggtgataaccgacgtatattgctccatctagatgcaaatgcttcagcatcccactttccttcactctctgaaccgatcggaacttttccaaccaccctacttggcaaatctttgtattcggctggattaggaacgtcatctgttgacaccagtccactagaacctgcaattagcttggaccagttttgacgaactccaacaccaagaggagtcactaatcctaaaccagtgactaccacacgcctgctagtcatcgttggatcaacttgataaagacactggggtccagttgatgaggccgcgaaccattaagtacttttctgtgcaggaaaaatatcgaaacctcttacataaaaaaaaaaactttcataggcataatctataattctcatacatctcatcatggcagggtcacagctcaagaagcttaaagcgaccttgaaagaggccggtttaactggccagaccaatgttaaacaaaaaggtaaacgccactctaggaagacgccgtccgataccagacgagatgatagagcacaggttattagtagaatcagggaacagttcaacccatttgaggttagaaaggggaaaacaaaatttgaggtttccaacggacgaagcgttggtgtagctaaaccaagcgtctccaaacaggttggtgagcaacagaggcgagctgcatacgatgtgacaaaatccagaaggaataaagtgggaggtgtgattgatcgtcgtttcggtgaaaacgacaagaacatgacaccagaagagaagatgctggaaagattcaccagagagagacaatctcagactagcaagaactcgttgtacaatttggaagatgacgatgggtccgataatgacggaattactcttactcattatggtaaaagtctttcacttggagacaacaatgaagataatgaagatggcgacggcgatggattcactattgttactgagaaaagacagttagatgaggaaacagttgatcaaccttctagaaaaagaaccaaagctgaggttatgcaggaagttatagccaaatccaagttctacaaacaacaaagaaagctacaacatgaaaaagactctgagaggatcatggatctagatgacgaatttgaagacattctaggtgaattgaaatcaatgcagaatgagaataccaatgactcgaaggctcctattgaggatgagaccaagtatgatgagactttacgtgcattgaatttggatagaagagctgttccagctgatagaaccaagactgaggaagagattgttaaagaaagagaagaaaagatgcagaagttggagcaagacagacaacttcgtatgcaaggaatggatgtcgaaaaaaccggtgaaggggatgaactggatgacactttttgggccggttctgatgaagaggtggaggaactgggagattttgtagacggtgaaaaaaatgttccacctgaagaatactttgaagaaagctcctcagaagggaccacagagaaaatccaatcgaccccctctgaatccgtaactataaccattggtaacaagaaggtagtttcacaaaattcttcgaaaaagactcattttgcatgccccgaaacacatgaacaatttttgcacattttgatcccatacaaggtcgaagagcacttggatgtgataaagagaattttaaatctttaccaaccaagactagcagaaggaaacaaagaaaaattaggagttttctcaacggtaatcttaggccactttctctaccttgccgatttggaagagccagtccctcaatcggttattgaaggcttgatggtagttttacgtgaaatggcttcgaaatataacgaacctttgacccaagcatttcgctctgaattgaagaaattgggggaaaaattggactctgataatgtgactgtcaaattgtctgacttgttattattcactgtgattggatatgtttattctacttcggacatgtaccatcttgtggtaaatccaactgtcatcttaatcacagaagtattagaaactctagacatttcaaacatccagcatctgcttattggtacttacttggcggatcttttgtatcagtttcaaagcttgtcaaagagaattatacctgaggttaaccgatttttggagagaagcatcatatctctctgtccagagccggaaaaactggactacacacaattgtatactgcaacttctcatatcaaaccttctggtttaaatttgcagtctaactccaagttggccagtcaagaattccaacttactcatttccatgaagcttcagtagatgacactccagctctgcttgagaaactgttacaaattgttgacaaatttaccctcatctggaaagaaaagagttcttttgtggaaatttcggtgccatttatcacgctatctaagcactcggttaaatactatgcttcagataagcttgtagttgatttattaggaaagctaaatcaactttacaaggtcaatataaaggagcatcgtcctttgaaattacaagcacacagagcaatttccattatgactaacactcctaaattcgaagagaacttcaacccagacaagaaatcgtacgatccaaacagagatagacaggaactgaacaagctgcgttctcaattcaagaaggagcgcaagctgacattgaaggagctcagaaaggacacccgatttactgctagggaacaaatcaaagagaaaaagaagcaacaagaagagtaccatgcaagaatggcctacatctacaactccatttccacagaagaaggtgcagacaaaaaccagtacgacagagaaaagaagatgcgcaagaagggcaaatagtatttataggtatatatgcattacactactgaggaggaccttgctttaatgatgatttaccagccttcaataactcgtcacacaacaacaggtttgaggcaatacctgttgatgaagaaatagcatttcgtaagaccctatacgaatcccaaattccctcaacagttggatccattggctcgcctgagttcaggtccacgcctacaactctaccatcagcgagatcatcctggcaattagctaatgtgtccaaagcatcgaatccagcattcgtagccaaggtcttaggaattgtaagcaaggcatctgcaaaagctttgacaccaaccttgctacgacctttggctatttttgattcgttatcggtcaagtatttggaggcgctgaggaaaaaagcacctccaccagctactagcgatttatccttgatgacattagcaactgcacgtaatccatctctcacggcatcctttgtttgagcaacaacatggttagtggctcccttgattaatatagtacaagatttagggtctttgttttcagtaacaaaggtgaatttttcttcaccgatagtgtgttcgtacacaagtccagagtaacctaaaacatctggggacagatcatcaactgagttttgagcttcacctccacaaatcaattgaagcctttccatgttacgtctctttgctctccttagggccaatataccatgtttagctaggacatccaacgacatagggtcgattcctttctgatttattataacaaagcccttcgattcatccaatccacaaacctcgttcttcaagtcaacaatcttcttcaacttttcatctacaaaccttctttcagaagccaccaacttgtctctttgttcagcagaggagtagtaaaaaccagaattcacttctgtcttctcatattccaacgaaacattgaggatcaaaacgctggcgtttgtgactcgtctaggcatgtcaggatgtctagcaccatgatccaacaccaatccgttgacgaactgggtatctttggctgtttcgtgcatcatagacatgatctcaatcatgtgcaaatctaagttgtcgtttgtcctaacttgtagcacagcatcagtcactattggggtcaacacatccgttaaatcggcgttgactttggtggagagagatgttcttgctacttgcaacaataactccctgtcaatggtttcagctttctgtacaaaactgtctaaaaagttcagagattctcttttggcaatttcaaaaccatctgtcaatactcttgggtgaactccttcagagatgaatctttcagcttgacgaagtaattcaccaaccaggagacaaacagtagtagttccatcaccagtaatctcatcttgagcagaggcagcacgcgcaatcatgactgccgtagggttttgaatctgcatctcagataataagactttaccgtctttggtgattttgatgtttccgcttccatctaccaacatttttaaagttcctttgggacccaagttggaggcaagaacactctgcaaaccttgggctgcggcaatattaacctgcagagcttgctgtcttctcaaagattcggcctttgggtttagtagttgaatcgacgaggacatttggtagttaattcttgaagagattaatttcgcctctattttctcgtgttcgatactgggaagagtttaggtgcgggtaacccatcaaagaggtacacttactttagattatgtaatcaattaattaatagggtatctctgtggttagttatatgttcaaaacctgaaagtcatccaaagttgaatcttcgtcgttgtaaccatcagtagaaagtttagaatcattcacaaacttggaaagatcgacgatctcctgagacattgcttccttgaagaaggtcgcactttcttctgttaggacggcattacccgaaggccgaccaaatgtgactgtattggtttgaagtgaagagccaacatggcgaagagtatctaaaaaggtctcaatagacatgttaggattttggagaaccttcagtttaacatgtctattctggtggagtgatggataaggaatgcaagtttctatctccgcttgagataatggatcatccaacgatggcacatgggaagtttcttccaaaagggctttccgtctgtctatttcctcattttcatgaaagggtaaaagctttgaaaaattcttttggggaaggtggaacttccaatttatagacttgtggctgagggagagtatttgaagatttagtttcttatcaatgcacattaagcaagcatctggggaaagtttccgctgtaaattagaaaaatcttctttccatttagtatcctttgcggaagctagaatgatcccaggaccaaattccatatccctcatcccggtacaagatagaacccaacttgtgttcctatcgtgtacaatccctaaaccatcaaatcgtattccaaaccagataattgacccattatttctgctgagaactcctatacccttagtagctgctccaccccataggaccctacttattataccgggtgtattccctcttctcaatttatcaaccaatactatctcattggacaatcttgtaaaatcccaaataagaatatcatcacctctgagagttgtggatgtcagcagcatatcatagggcgatatagaaacgtgtgaacagcccccaggtaccaaaaagaccagctttggttccatcgtgagcagacacactaaaacgatgtaatggctttgagaaattccattgagagtgtttaaaagtttagttatggtatttttgatattgttggatttctcaaccttattcctttgatctggatccaacatttgcttaactttctttgacgaaagttctgtcaatttgaaaatgctgtccatcgcagtggtggacatgttgctgagtactctttgcagtaacgttcttggtctaggaaccctgtattgttttggcagtaacttctcttgtgtttccacatcaccgtccacagacggaacaccaacacctttgcagatcaagtcatccgaagaagcattgtaggcaagccaagacccgcatacatctaccacaggcacgttattaatcacccttgcattgaattcgaattccacagcaaaggtcgacttgttgactagaactgttttacctttaccagttgagattgagaaataattggactctttgccacctttatagtataccttgctatcatgggggaacacccccgaaagaatgtcctgggattcaacttcattaccgattgtgtaaactgtgaatagcaaatcattgcagccctggtccacgcaatacaaaacttggtacacgttcgtgatgcggttactgctaatcaatttaaccatgattggatcactaggaagttccagactcgcaattaagtacaacgttccgccaggagtactctggtccattctatcgattggtagccagtcccacaattgcagattcctattatgcagcagtagcaattcaccaagcggaccaaactccctgaccatgtgaggttcttcgacgtcgctactgctggaattgtcatcaacaggggtggagacgaaaccagaaagggaggacccggcggagttcatggtgtctgatgccttggatttgaccttatcccagaaagcgccggtggaatacaacttggaggattccactggccttgtaggcttcctttttacgatgagatcttctgaagtcatcgattatcgaacacttcctgaaaaattacgctaattggtggtgttaacgcgtccaatgggtggtggtagatcaaaaggaagtgtgtggtttctttatcgtaaatcctgagtgataagtgagagatcaaaaaatagatcaaaactgaatcgggaagtaggcaccaccgggttgcagacgcggcgtccagggtactgtctctaaaacaaatgaattatattgtaacaccaagaagacttatgaacattaaataaaagcaaatatttggacactacgtattaacgtccgcagtatttcagctcaaagtaacgggcagtgttaaagcccaagaaactaaaccctgcacccaactcgaatcctacgtctcctccgaaatctccaatcaacctacctatggccccagagtaccagacctggttcattcccaggacgacaccagcggcaccacagccaaatccaatgagtccagcatatcctggaggagcagcagtcttgtcgtgccattgttcaagcataacgtcgtacttggacgagaatccccttttccaaataaaatgctccgaaagacacaccgtgtcgtagatagccaagttgtaaccgataatgttcatgaaattactcatgaaacgttcgaagtggtaataggcagggatactgatggctaaagtgacactgtttccgcaaagagtccaaacgattctgggaacacgtctagctttggaggtgacagcctgagcagacagaccaatggagtacatgtttggaatgttgttagcaacagtagacaaggccagcaaaacacagcagaattgaccgaacccgtgcaaggagttctcgaccaatacagcgtaaaccaagccacctacaccgttgtcgtagtagagagtagcccatgattcgtctgagaaaataccagtggcacatgcagttcccaacatcatggtgaaacacaatggagtgaagagtccaaaataaacccaggcaaaaatctttaagggaggggtatctgttctcatgtaaacggtgtagtcggctgcgaaagtagcccaaccagaagcgtatccaaaaattgcacctccgaaactgaggacgtttcctgccacagttggacctccggccatggtaccgaaagtaaagtttccagagatggacattctggcaatgataacgatgaacacaaacatgttgggaatccaggaccatttctcataggcatgaatgacatcgtaaccgaagaatgtcacaagaatggtcaacacaacgaaaatcagacatgcagcccaaggaggcaaagttttgttgttaacaatgtgcaacaattgggcagcagccatgatattgacggcaccccatccaacacaacagatacagttaattgcagcgaacagtctcatagccagatctccagacaaaaatctggtcaaaatcatctgtctaagaccaaacttgactccaaagacggagaaaaaagcaacggggaacacgcccagcatgttaaagaagataatgcatagcactgaagaccaaaaatccaaagcaaacacagtctgagaaatagcaccaagggcaaacgtaccgataaccaagttggcggagaaccacatggaggcggcctcccacagggaagttctagtcttctcttcttcggggacaatttcaatacctcttgtctcagccttcatcatgagagtgaaattctcataccaggcgaactttcccttggaaacttcagccacggactcatctacttggaagtcctctgtcttgacctggtatgtcgagttcttgtcagacgacccagcgtcggccttttcgatatcagttttgtaagcagacattctcgatgataaaacaactagagaaacaaaacttgaggagaagatagcttatccttatatacaaatgccaggtatttgagtgacccctaatttcggattcaaatttgcgataaacttaatcgatggatatggccgtggagatttgtaagtttttcaaccttggtcttcatcctgataagaaaatatttccgagttacacaggttttaggcgagaaaaaagaaatggcgataataaagcttatcgatgatagtacaaaagtccaccaaagtggccgcgctccgcggccggacgagatcaagtacgtacaatcagcgagtgatacaatctacgcccagttattggctgaaacaatacaattgaaatgaactgacatgagtggaaagatgcagagaactttttacgtttttttctggaattgaattatttattatcttggattattgatgtcatccctaaatttcttgggatatctgatatctgggtaatcagtgcgggtaatcgctcctacaatggttgcacatccaagtgtctaatatgctcaaatatgcgggcgcctttaacaggaaatcgacggggtagccccaactgcagcgaagaatttataaagataaagagaaagcacccatcatatgagtgagactttccaattggaagacagctagctggtctgctgataagattgagctataacggtgcatttggtgctgggaatggacagagttagcagacgaaagatgtattcaccttcagctttcgtggatagttacgctgtctacctgcaggctgtgggttaaccaatgtccttttcgagccatcaaagaacggagacacggcctatgatagcattctctgtggaccaattatagcacaatggaagcgaagtattattgcattgcaacaccacaattgcaatgtcgtggttagattagccggtttgtgaggcagccagatcttgcggtcttttggcatcctgtcatggattacgattaccggaatgtacctagacggttgggaggcatgtgaccagcacattagtctttaaaaaaaaggtagtgaacctgcatggttttatgacaagcgagattgcacgaagtgcaaaagtctggttattgttcatggcacagtgttgtcccttttggtagacaacactatttcagagcttgatgaacattggaggacttttgccttgaattctcattgaacgtctctgaaactggctatttctttttttttttttttttttaaacgtttcatttgagtgacatggtcttaatagcctgggacaatcatcacagactcgtttgaggtctttctggtttttttgtcgtttggctgctgctttgaagattctcctattggtcgacatcgatccattgcgtctttgggctgcactgaaaaaatgctagcattcgtctttcgatgaataacctaaaaaaaaacgataccaaccagcaaggttgacggacagcactggttgccctgccatcgtcataaccaatttgagaaaaagcttaaaattgcatcgtttttaggagatgatatttaacaccgtccgatttcccgtaatcttcccttcattagtacaatgttattccctagagaaaccacatgctcaactgagagtgattttaatggtgaacacatgggtgccagaatttcatcagtgtttgtgattctggttacctccatgtttggtgcctttttccccatcctgtcatcaagatactcgttcataaggttgccagactggtgctttttcatagcaaagttctttggctctggtgttattatcgcaactgcctttattcatttgctccaacctgcaaatgaagctctttcagatgaatgtttgggtgagggattcgaagactacccatacgctttcgccattgcattggtatccatttttgtgatgtgttttggtgaattgatgacatttagattcatggaccataagttagaagttgctgaagaaaaacagataaatgcggacaagatctcaaagcttgaaaatgaagaggatgatgaagttggaacgggtcttgacttgaatacacaaccagctcctgaaccccaacaaatgaacccagaaaacactctagagaaccactttgctcatcagaatgaacaccaagatattgagaatgttggaacattagtagacaataacttggaaagctacaagagccagttcatttccgttctcgttctggaatttggtatcatcttccattctgtgttcgtcggtttaactttggctacatcaggtgatgagtttaccacgttgtatccagtgatagtattccatcagatgtttgaaggtctgggtttgggaactagaatcgccgcaactccatggccacataaccgcaggctcactccatggttctttgctcttgcctatggtcttactaccccgattgcaattgccatcggacttggtgttcgtcactcttatgctgcaggttcgagtactgctcttatcaccaacggatgctttgatgctgtgtctgctggtattctgatatacacgggtttggttgaactcatggcgcatgagtttattttcagtacccaattcaatggtaagggaggactgaaacgtcttttgtgggcatatgctatcatgtgtcttggtactgggttgatggctctacttggaaaatgggcctaatcgactactttaatgatacgtgaatggtaaaacatgcagatagaattttttagtgtaattaatgtcgttagttgtagctgattatttcatacttctttcctagctagattacactgaactggtgatgcatgacctgaagccatattgtgagtcaggttaatccaagaacaaacgtccaacgtaagttcagcaacaatctggagttaaacaagtcttcgatgtggaaaaagaagttggaccttaactaatgacttttacatcaaatcatgatagaataatcacgaatggtgcaagagtgttcaacaatacttactcggttatcgcagatgaactacccccattaatattcatttctcattatccatatagcagccaatacatgtcatcgttcaacctactcacaaagagccgtcaccaaacaccacatcatcaaatatcctgaaatgctacgagttagccccttcaaataaatgtcttttaaaggcctctcaaaatattggcttgcatgtcctctgatcttcaaaacataaaaaaggaggttcgacagtatcgataatattacaaagaatgctactccttgtaatgattcaaccttcaaaataccagcagctgtcccaaaggccaatcctgttacatcatgaacgtactgaatcgccttctttgttagttcagactttggctatctactagtgaaaactcaacttactgcgttattgtgggtaatgctagagctatatttgacttgatctttggacatgtttgtagagaacaatagacagtgatgaaaggagaatgccctttgagagctctccttctggaaaatgctgtcgcgaagatttacccatttcaaaatctactcacttttggtaagcattatctcgtactttctttatttcccttaaccttttcccttttcccttttcctccaacctccttgtgtcgtaaatatgtcggcttcagggaatggaaagcttcagcctgataccaaaatcaaacaagaagctgcagttagcgaggtaactctcaaaagctgtacccgagaagagatcgaggatgtcagatatcacattctcaagttccaatcccaatcaaaagtaaacttcaacaagtttactcaacctgttcgtctgcacagaaaagatcctactaacctgcagtttcaattaacgaggaaagaaatagacgagcgtagagctagcaagaaggcagataaattggcgaatgaggaatcattggctgacagcaataaaggaactggttccagcgaacaacatggagccgacatgtctgtcgtagccccggatggaggtgcaaggcttgtcagaagagccaatttcttcagaaaaaagacaaaacaggtaagaatggtggatgaccaaaagcgtaagattaggtatgaagagtattatccttgggtattagaagattatgatggagagaacacatttgtaggaaactatgaagcgggaaatcctgacacgtatgtacttcttgtctttgacaatgatggcttcaaaatgattccagcggagaaagtctacaagttcaccccaagaaacaaatatgccactttgactttggaagaagccgaagcaaaaatggagaaaaattccaaagtgccgcgttggttaatgaaacacatgaaggaagacaatgcagctgtttcgaatgatattcgatttcagagaatgagaactgtagttggaggaaacaaatcttccaagaatgttgaagatgatgatctggatttcgacgaagaatttgcagatgatgaggaggctcctattatggacggtaatgagcaggagaataaggaaagtgagaagcgaatgagactggagatgtcaagagctaataatgttggagatcttctggctgaagataatgataatgatctggatgatctgttcgagtcacgaaaggttaaccaagaaggtaaaaagctcaagaaagttttggttaaacaggaaaagaacgatatttatgaatccgatgatgaggaaaacccttacctttctaagtcagaatctgaagaggaagaagaacaacaagaacctgacgtgaaaaaagaaggaacggagggatttccatcgatcaagactagtactgcctcaccgcttggtagaaaatcattgtctccatcactgggtccgaagatcagagttgcatcttataagcaaggttacattactctaaaggcagcacgctccgttctgaaagaatttcctgaaggagagtggaacccgtatatagtcaagcgtgaaattggatacgatggggaaattgaagagaactctccttcgaagagagtcaaattggaaaattcaagcgattcggagtacggtattatcacagaaaaggacgtagtcgatattattatggagaaacctttaaagttgaaagatctcatcagtacactaaaacacaagattcacaagcatcccgataataaggaaagactcaagaactatgtaaagaagctttgcagattcgatcaaggtctgctgtacctaaaggacagtgtatgactattaattgatgtatagatagtttctttatgcaacttctacaattctgtcctcatcatcatcgctttcatcgctgttcattgcgtccacctcttgagtagttggtgcttcgtctctcattaacatttgtaccaaacggtcacaaagttctgccactagttcatcctttgtgactttgtgaagttccctgattaaaggataaacagatttttctcttaataattctctgacttctcttgttacacacaacaatagtaaactttccagatgaacagcaataatgtcacttattggctctctctttttgtctgcaggcagtagttgcaattcttctggcaagttgaacatttcttcctcatctagctcctcagacccagcaatcggtaaaagtatgtatggtagcagattgatggcttcatcagtgagcagcttcatatgcttttcagtgtcgaataaggagttcttaattgttgaagctactccttctcgtctcactttggaatcatacttctctgtgaaaaccaacaactttgaaatgggaacaacattatcatagtcttgctcagtcacaaagtagtctcttccgtgcttgaatcttgaaatatcagcaaagaagtaagccaaataatcaaagtttgcatttacatttaaagatctgtctgcacctttgacaaaacagtccatcaggcaatccattatgtttgaactagtgaaagcgtcatccttggaaacacccgaaatgtccatgtcaaaaattctggtgatgtaatccaacttagccatgtttgccaacaatatacaaaacaaatcagcgtttcggttagttaggtcgatgattgacgaggcaacaaattgtataaatgcatcgtcctccgtgatcagccttctcatttcagtatcactacagagattagccaaaatagtaaccgcatgcccgaccataatagttgtcgttgtttcgggtcgttttaaagctatctctttcaaatctttgattggtctataattgtcataggcgaacagttttggattagcatttgctggagaaaactgcaccaggttatccaaagctatctgtttcactgcatgctgaggtgaatgcaaaaattcaactagttcctctaattctgtgggcattgtgtgctattggcaggaagtaccagaagggacgggaatggaaagggagggcgaagataactagaaaaattagctcttacgtaatcggtactcaagacgatggatgaagaaagcacagtttcgcgacaaccaatcagaactcgccaatcactaattacctacaacttattccaaaccagaacagagaaaaccaactactaaactcacataccaacatgtcagcattcacaaatatttataacctaatcttcaaaagaaactctacttatgttgccagtgtgtttgctggtgccttcgcattccaggcttttttcgacgctggagtgactagctggtatgaagctcataacagaggaaagctatggaaggacatcaagggtaagattggtggtggagacgaagatgaggaggatgatgatgaataagtgtaaggctatacctaacaaacagagaaaatcattaaatagataatcaaaattatgtccatggatgagtttttgggaaattcaagatgatgaacatgattatcagcttggcgatgctgcttgaaggaattaaaatggtacggtactggatctgagtctttgggaggctaatttccggaattgttcatctaccgtcaagctcatctcatgtctgctactcgtatgcattgatctgtagactgatcatgacgaccgatttcttgatgtgaaaaagaaatcagttgctgggaaattcaaagctttgctagtcgtgggttcgttctgctcctgtgttattcaacatgtatttattgggtaatttcaaggtgctattaaaccaacacatgtgactaagccgacagaatttaaagccgcccaaaatattccctcactgcccttatggcaatactgtttctacttgagcatcctagttaaatcctatagacctcttttatctcatgttcttgtctgtataatccttttattaagtgctccccagacccatctccatcaaaatttctggtagtcgcgtttaccaaactacaccaacaagtatccttactaaacgatctagggtggcaatagtacccaaatggactctttcgatagactaagtagctatctcgtgaggctaccgtttaactcggatttcaagtttagtaaccaggtccggaaagatatacggaaaacgttatactatatcatcacagaggagggccaatacttagaacactgttttccacctccacaagaactcccggcccttcaatggaatgagagaaagaattgctatgacccatcagattccgtgtcagatagctttgaatgggtagcggaggattccacccttactcattctgatcatcctggcatgccatgtgctaaaaaatttaaacgtggagaggcatgttatcgatgcttaacatgtagcaccgttgacacatgcgctctctgtcaagcatgctttgaaagttcctctcatgaaggacacaaatatttcatcaacattacccaaagagaaaacgtaggtgtttgtgattgcggagattcagaggcttgggcttctcccatcgggtgcaaacattttacgaaagatccaagcaagattccggatcttcctgaagattacctacaaagactccactgctatttttccatcattttagattataccatcgacgtcctggccacatcaactctatcaattggttcgaaccaacagaatttgtcatcagtcattgactactctaaaaaatcaaatctgagcgaacaagtgtaccacgctgaagataccactagttcgcattatatgctcgtgctttacaatgatcagttgaaacaatatagagatgctgtgcagtgtattcgtgcgatcaacggtaactccttagaatttgccgagatggtcgccaatcagatacaaaattacggaaaagcttatgttttaggtggagatgaagctatgatagaatcaaagaaaacaatccttgataattatgggatgcgttacgtcatcagaagctacagagatgttttcagggaggaaatgtgtgatgaaatagttaaatggatggataatttaactacaacgcctttattccgtatgtttcaatctgtgagagatgttttttgcgaggtgtttctacagaaatggtctcctggtttggctgatatgagtattgaaacatttaacgatgatcatttgttggagcatggacttttaggtgaattatatgaaattttgaattttccagataatttagtcaacgttcctcaaaggttttatatctcttacatgaatagcaaacatgaacccaaagtatgggatataagtagaggattaacacagcaagtgggatacgatctgacatctcatgctaaaaactcgttcagaggctcccgtttacagtacctttggtattttgacataaggctatggaagtccctcagaacgaccattcatgatatttacgtctctgcactattggctaaccaaaaatacagggttttcatcaactgtcagtatgttgatatctaccctcaaattgcccaaatgtttctcacactagatcgagagcccgaaaactctcttatggtgtgtttatcgacacagctatttgcctcctctgccaacacggatgtttcgcttgaacgaggtgatttgaagagaatgttgctggttgtgtattcttttttgacaagggtagagggggatcctgatgtcacggaggttaacttcgatgcaatgaaaaacaaaaaatggggccagatcatgtttgatatgagtcatttgataagcagaagtacgaagcatgaatttttatttgatcatgatttatggggtgacattatcgatcttgttggactatttcaaggttgttcaacaatgaaacgagcagccgaagagcatgtacaatatgagtcgaataactatgcgatttatttttatgctatttctttaatttcatacttctgtgaggcttttgctaaatgtgttacaagactgacggaagaggaatatcaaaaattaactagaaacgaaataaagagtttgatcaatacgctctatcaatattgcttctacaataaaaccgagaaggtaatcgctgatcaactttctgttttcaaaagagttaggatgcaaaactgcaatcctccggattttattgtgacgaactatgatatatcgacagaagtggtcagtttattacatcccttgcattcatttgtttcttgggttatagagatgaacaaaactttgaaaacacctcaagatctgattcatttatttgagcttgatgcagaggtgaacaaagttggtgcagaagatgcacaccgcttgcaacggatattcgaatttcccttaagaactcttgtgatcctatctcaaataaaaatcggatactgggttagaaatgggttcactattagaactcaaatgcatatatacagagacagtggcatccgagagtgtggttttatgcgtgacttgttcatggtacaggttttcttctcaatagaagatcccagcactgctctagtttccttcttggacaaatggggactgacaaactggtgtaatggaattactgaagatgaatctgtgtatgacaaagttactattccctatatcgttgaagagtcgcttttgagcttaattaaccttttgaccgaagatactcaccttgatgtcacttctgaggatggagggttggagaaaactatcaaaagagagatcatacacagtttagctttcaaacctctgacttttagccaaatcctaagcgaagttccggagcacatatcatgcgagaagaagtttgactactatctgaaggaggttgcagacttttcccctccaaaaggttatcacgacaatggattatacaaagtcaaagacaagctctacaatgcaattgatccttattatattcattatacctccaacaagagagaggaggccttacagattctattgaaacgaaagaaggacaagactggcgaatcagtggataaacagtatttctcaccaaaaaaggtgaagtatactaacaattctccatttagtagactaccattattttcgcaaacggacgtatttgctaagtttatttattcaactttgaaatacgttatagagtcgaaactaactttcagtgccacaattttcgatcttttgctgcatttgattcatgtctgcgtaatgattagtggaacatcgattttaaagcattttcttgatgatcatacaaacatatttcaattactatacagtagctcaaagaatcaaacatttagcaggtttcacgccaagttgaaggctatttttgtctttttgcatgactcaccaggtttttcagaaacagaggcttcaatgctccgagaaaaaataacggatttcaattatgcgtcaatagttagcggtaacattgaaccaggaaatgatgaatgcgaagtggaaagaaaacgcaaaataggaaaggaaaaaagtgccaaaattctagccaagtttaaaaggcaacaggagaagtttttgagaaataataattttgaagatgtaagtgaaacgagccaagttacaggatgcgatccaccttcaccgaagaatttcgaagaacaatgcatcctgtgccgaatacctgcttcagaaaagaatgttttcggtatgatttgccatgttagtgactcttcagagttccgggatattccttttgatgaccattactggttcatcaaagcattctcggataatgaatgtctggatgttaaagtttccaaaagttgtttggatgacccgaaatacaacgaaaaatggaaatctttcaacaatcgagtaaagaaaccctattctattggacctggactaccaacaacgtttcggtcatacgcccatagcaaacctgttgtatcaagttgtggacatgggatgcatttcagttgctacctcgagtacatggaaagtatcaaaagtaggcaaactcagataaccaggaccgtccccgaggattcaactaagaatgagtttctttgccctttatgcaaatcattgaataatatatttgtccctgtatcattacatcagaacaatcaatcattagccaattatttgaaccctggagcttcatttagttctcttactctaagctcaattgataaaatcgttcatcaatatactcatcagcatgccttcgttgtctcccaggaatttatggcacgttttcagcaatcattgggatctcagtcaatcaagaaaagaaccagtagcttccaagtatcatatcaggagtgtctgtctacctcgttgcagagtctcaccgaaagtggcagcctacctgtctcagaagaacgcgctctggatgtgttagtgaatactattgaatcagcagagattggattgcgtggaagcagtgtaataccagagtgtcccacgatcctgacccagaaaatctctaaccagttactgaccatattgaaggtatggaaccattacagagattgtatcattatggaaaatattaataatcaactgcaaggcgcagttcccaaggagctgacatttggtgaagcacaaattgccattatccgttacttcaatgcagaagacgttgacctagcgtttggatcttgtgatttcttcaagtatgtggtggccgtttatccctcagagagcttgggattatcatactctgcaatcgttcgaatgttctattctaaacacattatacaagcattttacaacctctgtgcacacctggttagcaacaacttttataataatgaggaatgtagtttcctagatattccatgtttgtcagacgatttaatgaacgaggaaggaatcgaatgtaccaaaccattggtgatccatttgcttttgcaacactataaaagtgagtttccttacaaagatacagacaaattttatcaagttttttattccatgattgttagactgatgactccattcctgagaagatgtgtgttattggcatccatgagaaatactgattggtctggtatagattttgatgagttggacgatattcctcttgagttggacaaactttcacatatgctgcatttgcctcctctgcatgagatgcttttggaaattttcgatacccgaacagctatgttgaatgaactctcatacagattgatggccaaacaatttgatattcaacgtttatctttgcagtatccagggtacattgaattaataaatctccctgagagattggatatgtttttcacatactactactaccgcatggagaatcggccaaaagatcctgcggtgtgtctcttttgtggaacaatattggatatgcaacaaagcgccatcggaatgaagatgggtcaatgcaacatacattgtaattacgattgtcttaacgaagtgggaatattttttgtccccaagtgcagtgcaatactggtgctgtataatggaaatggatctttctacgaatcaccatacctcaattgccatggagagttggatgaggaggtcaagaataatagaccgctctatctgaatgagaagaggtacaagcgcctaactaacatatggttacaacacgatatacctaactatacagccaggaagctcgaaggcactgttgatattggtggttgggatacaatgtaaatgatgggaagataactcatactttatagtttctatttagactccaaagtggtgttttccaaagattcggttgtgctttgcacatcaggttgaacagcagttttatttgcagtagaatccacagggtatctggttcccttgttcttaaccttcttttccttcttcttcttttcaatgattggaggtgggtaacccttggcctctgcttcttgaaattctttattattggcaaactcctccctaattggaagtagtaactcgttgattgcatcagctacaccagatttcaagtcgggaggggccagcttctcgtctttgaaggcttgcttcagttcttcaaaagaggaatagtctactgggccgccatatttttctggacggtcgatgtggaattggaacccactaccatgttttagttcataaattggagccagaacatactcaacaaatgacaacagtccattctcttcaacattacctggagcgcagaaggcagtgtttatcttctttttcacagattttggttcttcaatgacgtcaacctttgagttcggatctgaagcagacatcttgcctccctgggctagaccaggcaccatagggttcataaggtgggctctcttcttgtatcctaaagattgtaagttctcttcagccaaaacaaagatttttctctggtcgacacctccaaactgggcatccaccttcaaatgttcttcatccaatgcttgcattagtgggtaaatcagaccagataagagaggatttgcaacctgtttgaccacgtcggcaccagctctctttgcatcattctgggaaacgctgttcgagattctaaatatatccatagtatattcaggggttagttgatatgaagaaccagttacaaacgtcagtttttctattgggacgttaatggatcgaagaatagccttaatcacaaattcgtagtatttggctctgtaagctacgacctccaaaggagccttcatattatccaaataggcatgcagatcggctaacagcactttgacttcacaaccggccttcaagaagtgggcaagcttggtcattgggacaaagtaaccacagtgaggtctgccggtgggggcagttccccagtaaagcttcaagggccttttttctttttctagaacatcttttatgatctgagggttcagaacttcctgaaggttcttggtgataaggtcatactgttcttggggatcagttagtactccagacatcttgggtgggatcttggtgatttttttttcaggataatgttagtcagaacttaccgcgaacccatggttggagatggggaagggagacattaacggtcagagcgggcatgagatcaacaagactagggaagaagatggagttaccattggtggttaatagaatgaactcataatcatatatagaagaaaaggaagttgtgttcttccattagaggaaacgcagcacaaaaaagttaagtatgacacggacaggaattgaacctgcaacccttcgattgcactgtattccaactggagtcgaaagctctaccattgagccaccgcatcaactgtaaccaacatgcggggtctaaactatatgtacatcaaataaaataactatgattcataataattaaatatttaaatggaatactcaacagtattcggtggttgcaggatactataagtagcaggagctattgcaaatgaagggtttaaaagttactttgaacaaaaccacgtaaaattctcaaataatactgtaccctccaatataaaatgtcaaacattagattgaattttagaaccatgacattagaacttagagtaacacgggctgtttttaaaaaagcacgaaattgtattcaacctaacacttcattctacatgaataaagaacgaatggaagggattaattgctttagttgacctagacactttaaatcactctttgattcaaatactactaattcttaaccaccatggcccacaatatccatacataatgtgtctttcatatttcgtaatcataactatttttgaattattaattattgtaagtgccattacgattacatgatctcgttccatttttcctcccacttccattaaaccataaaaacacgtcttctctttcaataaagcatctgcattctctactagcactgtttcatgtcctatctaagccaatcctggtccctgtcactcctccctcctaatttagtttactcaaagtcatcaactttgccttgaatgcttggaaaaataaactattacataaacatcgtgcggcgtggaaaattttttttttttgctagttataaggactttggaacccactttttgttttctctttttttggctacctggcccatatcggtttctctactatccttcgataatcacccgtataactgctcaacaatgacctaccaagatcacactaaggctttagaactcttatctacctaccccgagaaggatggtttggacatcaagtctttgatggactccaaggctaagggaggactgacctacaacgacttccttgttttgccaggaaaaattgagttcccatcttctgttgtttcattgcagtctaggttgaccaagaagattactttgaataccccgttcgtctcatctcctatggacactgtcacggaggctgatatggccatttacatggccttgttgggaggtatcggtatcttgcaccacaactgcactccagaagagcaggctgctatggtcaagaaggtcaagaagtttgaaaacggtttcatcaacgacccaatcaccatcgctcctactgttaccgttggagatatcaaggaaaaaagcaagagaatggggttcacctcattcccagtcactggtatgtattaatttttgttatttgctctcatttttttgttgttcgaatcaaatgatgtttcacaagattttaaataactttcgttctaccgatttagatcaaacgatcatggggaaaagatctatttctgatggaacaataaagagaaagaaagagagcttggaaaaatacccgaatttagttactaactttgagtttagaggatggaaagctgtatagtaaattagtcggaattgtcacctcaagagacattcagttccacgaggatgatgattcccgtgtgtcagaagttatgactactgacttgattaccgccaacaagggtgttagccttactgaaggtaatgaaatcttgagaaagtcgaagaaggggaaactgcctatcgttgacaaggaaggaaacttggtttctttgctttcaagaaccgatttgcgaaagaacttagacttccctctcgcctccaagttgccagaatccaaacaattgttggttggtgctgctattggaacccttgatgcagacaagatcagattggctaaacttgctgctgctggcttggatgttgtcgttattgactcgtctcagggtaactctattttccaattgaacatgatcaaatggatcaaggagaatcaccctaatctgcaaatcattgctggtaatgtcgtcaccagagagcaggctgcctctttgatcgctgctggagctgatggccttagaattggtatgggttccggatctatttgtatcacccaggaagtcatggcctgtggtagacctcaaggtactgctgtttacgccgtttctgagtttgctaacaaattcggtgttccatgtattgccgatggtggtgttcagaatattggtcacatcgtcaaggctctagcccttggagcttcttgtgttatgatgggaggaatgcttgctggtaccactgaatcacccggtgaatacttttaccgtgatggtaagagactgaaaacttacagaggtatgggttctattgatgccatggagcagactgctaccaacgccaacgcttccacctccagatacttttccgaatctgacaaagttttggttgcccaaggtgttactggtgccgttgtcgacaaaggatctgtgaccaaattcattccatacttgcaatctggtcttcaacattcttgccaagacattggagttaagtctgtggatgagctcagagcagctgtcgatgctggagaagtcagatttgaactgagaactccatcagcccaactcgaaggtggtgttaacaatttgcactcttacgagaagcgtttacacaactagaaaaaaaattggccataagccatataatatattaaaatttggtaagacctcaagccgatggctatgtagacgcatggaagtgtagtcaatttgaattcgacttgcatgtttgaaattttcagactccctcaactcgagacctcaaaaatcattttaacctacatccgaattgacctactcggggaagtcaaagaatactaaggtcactacaacaattttcttcacctattatggacgaatttcttattctacttcgctataaaacataagtactgtcacttagattagacggtctccaaaacaacatcttggaactcagatccaaccttcttaccgttctcctcagtgacagactcaccgtgaagagccaacaaagcacccaagtcaaacttagcttgcttcagcaccttaacttttctgatgtgaacgttctgcaatgggtagataccttcagcagccttctcgatctcacggccaataacctcaggaatcagcttggaggtcaactgagccaatgtgacgttggatacctctctttgcatgatctcaaccatcttcttacggatggcggacagttgggatgattgagcgtaggtggtcttcttgatctggttttggtgtcttctggtgaaagcaatgcagaagattctcagcacgtagtcatcggcagtcttgacggtgacgttggcctcaaccagggattgccattttctgaccaaagatctaactttgtcagaggtgaagtcgaatccgtggaagttggtcagcaagttcttaccttgaacctcatcgactctcaacttaatcttcttgaaagagtggtcctcggatccttgcaagtcagcaagagagacttcgacgacacggcccttcaaaccatcaacggcgttcttcaaaccagtcgacttgttgatcaaagtcttaccaacgtttctgttttcaaaagtggtaggagccttgatgtcgtaccattcctttctctggaatgggtcgacaaccttcttcttcaaacctttcttacccttggaaagtctcttgttcttaccgacagccatctttatgtagttgaagtgtttagtaaaggatttttttctttgcgaattttcaatccttagagagagacaccactagtgagggagcgaaaaaaaaaggagtcgtgttcttaccacaattggtggataccctagtacgcgagctcccattaaactgaaacacatctgaacaccaaagtgacgacgatactacttgaacaaatgtacaccctaaaaggtatcacgtgtttatggtttagatattatttccctatttgatcaggttccatatgcacggtctccagttatggagagggtagttatcttgtttacttcacacacgcagttgacactaagatcgtctctagacagtctttaatcgacgcaaattgagatgccagactctccgagaagaaaccagcacagaagaagccattcagagcaacagaatgtaccacatagtcaaagggaaactaactcagtcgccgtcaaaattggcctgattggagatgcccagatagggaaaacatcattaatggtaaagtacgtagaaggctgttatgatgaaaattacacacagacactaggagctaatttcatggagagaatcatcaacatcagaaatacccagatcacgctctccatttgggatctgggtggggagaaagagttcattaacatgctgccattggtgacaactgacgctgtggtgataatatttatgtttgacctgaccagaaaatccactctaaactctattaaggagtggtatagacaagcaagaggtttcaataaaacagccatcccgtttttggtgggcaccaagtatgatctattcatagatctaccagatgaggatcaaatcgagattaccaatcaagcaaagaaatatgccagagctatgtcagcttcccttattttctcatccacaagccattctataaacatacaaaagctattcaaagtcatactgagtaaagtctttgacataaaggcaaccataccagaaatagtaaacacaggagaaccactattattatatcagtcaatatgagggtaaggggttagtacataacctccttgagagtgtcatcttttttgaacacggtggtgatttcatcttcctcaatgttcaacttgatcagtgatgatcttccaagattcccattctttagaattattccgttttctattagttcttgaagaataaaatcaaaactctgcatccgggttttcaatcctccaaaaatcacccgagtgaattgtagattttctctttctaaagattctctaactttctgaaaatgattgaccttaaccatgttttgcagttcgtcgatgatgctaccgagagtgttctctgaaactcccgttcttctgattctcgccaaaacacccacaagaaatagccttaaatggaaaggtgaacagttcagataagatgtcacagtggaggatgtagattcattcacagactttattatgtgtgctatttgaactgtgaagattccacctaattcggccttctcttgctctgtcttttttacgaactccttttcggcaatttcgacagctcttagacatatgctaagtgctcttctagcatcaccgctaacgcttgcgacctttcgtgatgcaaactcaatagccccgctgttgatgaccagtttatcggagttaagtttacctatgctttccaacctgtgcttgattatttcagccaattgagaaaaattatagcccggaaactgtaaacgaatcattcccaacctactggaaattttgttagtaagtaatcgttctggcaaatccatggtattggctactgcaatcactattaagctggaggaagaataacttggccaattgaagaagttgtaaaggacagactgattcttggtcaatatttgatccaactcgtccatgagaaccactaagggctttttctttttagaggaattaaagtattcttccaatagtccaactgcctgaccacttttggatctttgaccgaatatttttgtaaaaagtacttcgtaagccgcttgaggtgtcaacaacttcaaaccgttgatttccaaataatcaaatacagacccgtgtttttcagctaactgttttatcacctccctaatagtgacagttttacccgttcctggggttccactcacgtatatacacataccagtgttattctcaattgcaacttcgacgctcgtatacaactgttcaaattgctcatcacgacacggtagtgtattaaggtgagctccagtatgtaatcttttctttgcactgctgaacagttttgccatgggtttagcttgttcgtcttcgtcgtctttcattccttctaagttgagctttttggaagatacttggggaaatgacggaatattgtaatacctctcagaggtgggtgtactataaagcactctttttgacctaggggtgcctgttttgtttagttttctgttatatttctcatcatcagactcgtcctcatcttcaaactcgctttctgaacttagctcaacatattttcttgctttcctaccagagcttaatagattcgattgagatgtaagtgactttatagttgcagaccctgtaaggtttttcacgttgtgataaaattgttcggggtttttcttcaatagattatggaactgatcccattcaaagctatcagtgatattgctaccgtcatgatcacaacaatatcgacacaagaacagttcgtttgtatttgaatcattaatctctattgcatcgtactctaatttggaaactacttttacctttcgtagaatgtcttttagttttattctatcagtaactggggtaagaaacagctcattcttttccacttgacggccttctaagcgtgagctaagatctgtagctcgcaagaaccacatagccctcacttccaggtaaacatcagtcccaaaactaatatcatgtatcaatgcaaagtctctgaattttgaattttgcacttcgattactgttccaatctcgatctctaaaccatcagagtttcttttaagggtaagactgtcattcaaagtatcattccttcggctacgccttcgaggagtatcttgattctgtgattctacatcaaaatagtactgccatcctttgaattggcgggccgttgaagccattgactagagaatggtgcttgacagttgaccgtatacccactaaatactccctgtgctggaatcgcgtgtatccaccaaagggtctaaaaatggaaccccttccaggcacccttcgagagatcagtttcaagatagcaccttactctttggaaagggtgtacagtcgattccatgatgcttcctagcatgtctcagtatctgtctcccacaatgaaatacagatgcaagagtattctatacacaatcgaaagaccgttcaagaatctcactgtccgagcaagagttctccagatctgtagactcagtctctctgtattagttatgactttggtgctggtacaactgattggcccgtttttaaacccaaccaaaatctaccttgctcggctggagtgttctcatgtggatctttcaaatggtctatttaatactttgagagactctgtgagtaccaattcagaagatctctctggacaattaggccccggattgactgcttctgagatcaagctgttatcagcctacgccatgaaacaagtagaagacgctcctcagttcatactgtccaacctattaaactggtgctttggtacgtataataatcattcactcatcgatcagcattatcatgaaaatagaatcacttcgatgcagtgtaccaaaaaagacttcaattacaactttgattatagaggagagctctcttccgtcggtcttcaaattattttgtcttatgcctataagttagaaacgaagataacgtcccctaatgatcaatatactcctgacaagaaatatttctccaccattcaaaaaagacagtctctgaacaagttggcgactgctttgttgttattgggaatatgtctacagtttgttctgctggtgtctgccctagtaatgtattcgcaccgtggatctgcaagggatgacaagagtgtcaacatcaattttaggagttttctgagcagtatagccattggctcttttgcaagtctggcaactgctatcattgcactgctagtcatgtattcaaatatttctcaagatgtggagaatgaattgagtcagtttggcctttcagttcatttgggtcctgtgtttttcaaagtgggatgggtcatagtttcggcttcctgtttgttggcatttttgtgggcttttccaacttggtgtggagcaccaactcgtaaagctgaaaaccctgatacaaaggcgaatgaaaagccagcacagctactttttcctagtgatgaacattcatacagagactccctgggtacatcagtggacatttccttagacgagcgactccaataccaataccccacagtaccagtagttacaacaactttgccatcttattcaaagggatttgaagacaacgattactctctcattgagaacagaaagaatagtaggagcctggtgtaaattgtgttcacgcttcctttccatgcggctgttcagttcctcactcgtcccagcacacaaatagatttatcttttgccgatacccattttgtgaaagacctttttttcttttactgcttgcaatgttcggctattcagttcagaatagaaacccatttctgggactagctgaagagcaaggtcctcgtcactcatctaatcggcagcaaagtttacaagaattagagaagagtatcatagaacctgaaaagatcgaggatgtcttagatcctgttacagaaaagaaggataggccacatgaagttagtcccaagaatagtttgaagggtagcttcgtcattacagtgttgctctttactctggttttatttttttggctcgtttgtttagccggattaattgtaaccatgcatagttgtagagaagactcaattttgtgtttgccccaggtatccttccagttatcaagtgaaactccaattgcaaaagctttgctggtcaaagcagaacaggcgttgagactaatatcctacattgccgtggatctgggcgctcatccgagtgaagatggaaatgtattcgtgaacccacatttgagggagatggcaattaaaaagaatctccagaacccaaccgagttcaactccgttttcaattatttgaaaactgttgacactttaactacagacaatatatttcggctaaatttttttggatattgcaaagatcaactggcgaagggaagcagtatatgccaaaacgaatggggattggatttcgtgtcagttttactaagagatgccggtgatcagctgtcacagctcacatcagatcctgaactaggtagacaattagtgggcgagtcattcgttcaagcatataaagggatactgaagcaggcttcaagtttgaacttacaagatcgaaagctagaaaacgcagttttgcttagtagggtgtcgaaaatagtaccactactagtgtttattacatgtatttccaaagcagtggatactgtattaatgatagtggctatgggattgtatatctggaagaaaaatgggcatgcgaacatcatccagatattgttgaacgtgatttttggaattcatctgatttctttaataactggatttctaagtgtggttttggaaactgagtatttcattaaactgtcagccataggggagcagaccgggatcgctattgtggtactggatgttggtagttacgtggtattcgcttccgcttttgccaacgtgatagtgtgctttctacttcttataacaatcctaaaaagaccgtatatttagaattcatacactgacttttcaggaatataggtaatcctccaattgaaagaactgatgcattcgatgtcaaagctggtatttatcgtctcatcaaccaccatggttaagctcaagccaaaccatgggctccattgacttctggtggacgctgatggtaatctggggactggcacatcaggtaagagactacaggactctccactcttactgacaccagtttcatcaaatctgatctttagagaagcttgaatgagataagatccagaacccggtatcagatgggcgtcgtatgataaaagtgaatgctgagttgtaggaacgctgaaccaaatgtcctgaaattgggttctagacccatacggtgtgccattaaggactattgccgcttgtgcttttaattggggaaggatcctcgctttgaaaacgttgatgtcattgttgaagagactgggattttgaatgaacgttgagtctaacgtggccaggatgtgtttcaggaagtcctgaattttggacgtgggatctgagttcatattgtgtaagtaagatgaaaaacaatttcgaaatagcgagagacagtgataatgagatgagcagcttcttgcgggcgcctggtaggagatatcctcgacccaccaagtttcccttctagcttcccacgctacgaggtagtaaaaaataaaaatatattcacccgattatcaaaatcaatgtggtactgaaaaactatatgttttacaaggcaaagactccgaaagtgatactgacaactgcggcagtcaaacccatcaataaggtggactttgggtgatcgatagacacagcagcgtcggtagaagtttcagtctccgcgctctcagaggcggaggtgccagtgccagtgccagtagcggaggtctccgattcagactcagattcagactcagatccagtctcagtttctgtctcctcaccagtctctgattcttcctcactttcaccagtctctgattcctcctcactttcaccagtttcagcagccgcaacttgtggctcaattctggaggaataccatggcaggttaacaacgaacgatgaaagttcgctcgcagggaaatcctcctcagtaaagatacttgtgtaagaatcgtcggtgtaagtggccagttcagtgtacagactcaagaggtcagtgaaaccagccgcagtattggcctggatgtaagacagatactcttgggcgttctcagtgacatcattgtagaacacagtgtaaagggcttcatctgcctgtacgccggcagcggcaattgcagttaaaacgacgttagaaaatctcattatattagaacggtaggaagttggtgaatctgagcaatgtaaagggcctcaattgcagtgaatttatgtcccttttaaacggaaaaacttgctttcgtcaattaaatcacgactgcatggcacatgcaagacaaatatagattttctcctttagcgcagagggcttagttggtgcaccttagtaatgtcgtccgtccttggcttaggcaaattgataggtgcaataagctacggattgactgtgataactagttgattactgttcaggtaaattactaatctgctaccgttgatccctagtgcgatggagttcttttacctcacgcatgccccatgtgggaccggtcgcaaccatttgaagcaaccttctttcctaccctatgacttctccacaaaactgatttgcccttttaggacatgatggagaagaatacgcgaactatggtcgtcatatgggatggggatggtataattccgagggttcttgtgctagggtcatgggtttgaaggcattagggtgcagatgcagttggcgtttccaaaggggatatggattagtctatggggaaaatagcaataaagcttctcggtttgattagagttttggtgggggaaatgtggcaatatgtttcaggatagaaccaaaggaccaaagaaccattaaggtaaggttaagtttgtggggcctgaagccaatacgacagaggcacccagcaagtgaatctttttgaccgatcgatctcaggtatggccgatcgttcgagtctgaaaatcttcgatctagcgttttgcccgtccaagggattgttcttctcaccccggtcagcggccttcaagaataatcgtcacccccgccctcgtttccgcccggaatcccctaggcttatattttcatcccccctttcaacagctagtagtcatcccttatcatggaccatttgcaatcattgtacaactcaacaataattcaatggccgctcaaatatacgccatcgttcactagttggctcacacatcattttgcctctttcaacgccctcgttcactccaaactaacgtaccacgcacctaacttggtggttcatcccacatcgacagtaatcactttcctgttcgtttacatattcatacttttgattatctatgagttgatattacatctaggagttaaactaaattggtggcagaaacctggaagcgagtttttcatcgaaactccagtgcattgtgcccatatttacgtagacttgcacataatggaaaaacatgaagatgatgatcctaagttggaggagctgacaattgaggagaaattttacaagttccaaacaaagaaatctacaaaatacgggtctttaatctttcataaactgaaatatcatctggagtttggtcccaacgattacgatccacgagaccctgatctcggaacaactctagggttttcccgttccaaaacgctaaaactgttcaaagattccaagatttacactgaagatttgaataaaataccactatctccggaggaacttatcctcgttcatagaaagaaggaattgactccggatttagacgataaattcctgtgcgagttggacgtggaaactggcaacaaggtcgatgccttcgtggtgatctaattataaggcctttaattctccattgatccaattccatatcttgataaagttcggcaacttgagctctacgaacaccggctcattcaacccttcgttggtgaaaaccaagatgcttgtgtttaccagcaatgcgatctgtcttcgcaatttgatgtcatagattttctgtaatggtgttggcaggcttgcattatggcttgccaattgatctttatagcataatagagccattgtcaattcaatatccttgataaaactttcattctgcagtattttgatggtcactagtttttgcttgatgaaatgaataaagttatccagaaactccttatcagtcttggccgaagaattctcctttccaccttccacgtggcgacggaaagtttctatcaactgcaaatgaagcaatcggaagtaaatatactgatttgtttcaaacaacatagggtaatgttgtcccagtaagcttactgcctcatcgacatttcccttcagtatgttttgcttgatgttatttctgacgttgatggtggcaagtcctaacgacagcttggttacattctccaaagtgagaatgttgagcttggatttttctactttgaatcggaacttgtcacacagctcttgagacttacgataattagctatcaattgatctgcactgaaacaatcatcacccttgagctcaattggctggggataacaagtttctaacaagtcttccacttgcaagttaagtcgcttgcaaacactcttgatagttttgacatgaccctgtattatcaaatagttcaaaattaaatagtcaactttcaacagttccaccatctggtcgtcatcgatatccttacagcttgcttcgtacatttggtcaaaaggggatgagttgtccagcaaaatcccctgattcaaagtggtgaatctggctgcatcactttgaatttcctgataaaactcttcccagtcattcatggctgaaggttctagtgtgggtgaggtaggtggagaacataatccatcacctgcgcgagttacatggaaagtcttaagtaagcactgagtagatggttagcctacttatcgtttataaatcactcgttatctatacacgcacaacctgatcaatggcagcagctacacgctttacattattctcgttcaagccggcaatagaagctcttcctgacccaactaagtagatgccgtggtcagactctaacttggcaacttgctctttcttcaagccagtgaaggagaacatcccctgctggttcacaatgtggtcccaatttcctggggttcctaaacgaacaagctcgtctctgagagcaacacgcatcttgtgaatcctggtactcatggtgatcaaatctgcttcccattgtttacgaaggtcaggagaattcaggatcttaccaacaactttggcaccatatgccggtggattggagatttcacttctgatgatcttctgcagttgggatgaaacagcttttgacagcttttcatccttctcaggcaagacgagatggaccgcaccaaccctctcaccgtacattccacagttctttgcgaaagattggcaaataattattgggaacttaccctcatgggcaatggcagtacgaacagcccagttgtccttatccaaagatccagatgcaaaaccttggtaagcggagtcaaatagaggaagatgctggtactgtgcaagagcatccaaaatttgcttccactcgtcctgagttgggtccagaccagttgggttgtgggcacaggcatgcaataagaaaactgaatgtttaggagcagatttgatggcatccaagaatccagccaagtccaatgacttggtagcatcattccaataagggtacttggcaatctgcagtcctaaggtatcgaagatttgaacgtggttggcccaggttgggtcagacaaataaataactggttccttgtcagtggagttgattttgtagaacttcttaacaaaggcacctacaacatgaagagctccggttccagacagagactggatcgaaactactctgttttccttcaaagcgggtgagtcatcacccaaaataacttttgcagcagcgctggtgaactcagcgaaaccagaaattggcaagtactcatggttgtaaagaggatcttctttaagaagagtctctgcacggctgacagcggggagaacccaaggctttccgtcgttatctctgtaggcccctatacccagatcaaccttatcagaacgagaatcggctgtataacgggccttcaatccaaacaatggatctggtggcaactgggggatattctgcgttgaaaacgacatgcttaacggtatgttgacgagttcgggagggggtgtgtgagtggagtctattccagaatgggcgcgtccaaccttatatagtcaggcggtaatgcatgtgagattgaaaaagtcggggaaagtaggacgtgccgcagaggctacgagggaggaaagaaggatccgaactgctattgtgatggcataaagtgtggatgccggatggtagactacaggtgccacggtccaagcggataaacatgtatttatcggcctcatggcctttatcaaccaaatatccggccacatcatcgtcatgtgcaaggtagtgtcagaaacgactcaaattattttattcataagagctatgactctatgactgttttgggggtgcatgaaaaagactacatacaaaccaacaccccattctttttttccactatttgtagggctgagctactcgtctacaactggatgctaacaatatttgccgtggattattatcaaaggcaatgcgagtgggttaataagtattggaaatgagagaaatatccgcatgaatagtcccggggttttggaggctaatattcgggagagtaagatttctaggatgccctctatattttagttaggtattgcttagcttactgtaaaggttttatgatttcttcgtacaacagctccttcaggtctaacatggttagttcctccttccgtcggtcaaaatcaaaaaagtcgtcttctaatggagcagcaacaggttcgtcgttaggatcgtggtagagctgcaaatagggatgcctgagggcatcatcaacgcagattcgcctagctggggaaaacgtcaatagtcgacttaaaaggtccaaacctaaaggattagcgccaggaaataatgttttgaaatctacacctggtcgtggtgtcattgatccgacatactctctcggccgaggagacttgatggcagcaagatcttcttttccaggcgtgcccagcacgtcaaagatcaacgagagttgatggtgataatctttcccgggaaacaatggagtgccgctcaacatctcagccaagatgcatcctactgaccaaacatcgatagcagcggtgtactcttgaaaagtcaacatgatttctggagcacgataccatcgtgtcgccacgtattcggtcatgaaaccgtaattgtcttctgttttcgccacagagcgggctaaaccaaaatcacaaactttcagatcgcaattagcgttcaaaagtagattagaaggcttcagatctcgatgcaaaacattggcggaatgtaaagccttcaatgctctcaaagtctggtaaacaaagtattgacagtggtcatcacttagttgttgagtacgaatcactcgatgcaagtctgtctccataagctcttgaataaggtaaacttcatggaaggatgaaaaatcgtatggaacttggatgtccaggatactgatgatgttctcgtggttgaaatgcttcagcagcttgagttctctcaaagtgcgtaagcagaacataggtttcgaaaacgggacaatctttttgatggcaaccttttgttgtgaaggcagatgtatagccgaacacacaactccataggctccttcgcctacaatgtctaggatctgataatgatggctaacattaaaggaaatacttcgttgaccgctcgccataagatcgcagttaacgtttgactgttcgcaaatgggaaggaccaaaggatagtagaatgggtttgaaggagaggttgttttgaactggacttgtcaagtgcatactaagataaaacctttatcttacactcgtgttggactagaattttttcgcgaatatttggcgtttttttttctctcgcgagtttgactacaatgccacatccacatcctctgcctggcgctccgtcaaaatgttattaaacgcttttttcctttcgtggctctctttgacttttcctccttgcaccacgatgtcccctttttttcttgcccctcccataaccgcaagggcccccctagaaatatttttttaattggcactttatttgtcgctattatagtagaaatctctgctcccctattctccttctgtcttgctaacatgaacagatcactatccacaagcgcttttataaatgcccatcctgacaacctgttaatctcctcagatcggcgttccacgaggactacatctttcataagcatctctgacatcgaagccttgcacggaggaaacggagatgagtctcagtctaactccagtgttggcacatcgtctagaccctcattttccagagacatatcaaggcggcgaagctcaaatttcattcgcacattgaagtccaagaagcttctgaatgccataaaagaccaagacatccaggaagaagagcggtcaccatctccatcatcagacgatgtcttgttaccacatgacgttaccacctacacaatttccaacaagttcccgttaccagtggaaatcctcaacacaatcatcgaaaacgtctattataacagtgtggagaacgttcagtctattacctccaacttggaagagttctccaagtccatcgtcccagtatgcaagatgttcaacattctttcctccagactattgtacagatattcagtattcactaggtccaattcgtttgacaaattcctgaagaatttaaataaagaccactttttagggttgaacgttgagtttctagactttatggagtttacttcaattggactgggaaggacgggacgaatgaacgaagaaattcaaatggtcacctcatccacaatattaaactgtctacagctaacgcctaatctaatcgaatttttgggaagcgaatctattgaaggtgatattgataaacggattctctcgcagttatttaataatttactctatttaaccactattgatttctgtgggtcaacaggcgacaatttcgtgaatgccttcaaagaattcaccattaatagagatgttatccctaatatcaccaaaattgggttccacgactgcattgagcttccattgcaagttttccaaacatttctgcctgcccttgtcaatttgaccagattggatctgacccatactcaaataacaggcagatttttgtctgacaacctcccaccgtcagcaaggttgactcatttatctctttcaagatgtaaccagattaccgccgttgagctcatggactttttactctaccacgaatcaatcactaacgggtctttgaaatggctatctcttcaatgtgactcgtctatcgtctccatcctcaacgagcaccagttgagtcatcttttaaccaacatgaacgctccaaacttgatgtacttgaacttaggtggttactctgtgaaaaagaagcatttagacatcatcaaaaacaagtttatcaacctcaagtctttaattttggctcactcacagctaacgattgacgaactttacgaatatctctcgccaaagcataagcaaacgaacgcgagattcttcatccagggactcgaccaatacacccataattatcccacagaaacagaggaggaaactgatgaagctaacgaatcagatgaaccagaacagcaacttaaatttatcgaccttacaggtaacaaaaatgtcactagatggtcgattgacaacccaaaaatacttaacgcatccacttccctgcttgctattgagctggaccaaacaatagtagaagatattggatatggaccagaagggaaactcacaatgaaccaagatatttggaaaacctatgactcacagggacgtcgtagttggctctttaagctatcaccggaagaagttgagagggaacgtagaggagatcatgtggactattacaacaccttaacctactacgatacaacgacaggtaagaaacgtacgaagaaagcaaagcctccatttttcctcaggtttgccgctaagaagatcaacctttcgattggcccatttgccaccctttatgaggatgagaaggtttttccagtcgacttcagtgagagaggaatctataagtactactcgttaaacagataataagcgttaatacctaaagatttcggatgttcccacaccttatcttaaactttattttttcctaacttttttgctcttactcacgactgtgtcgcggcctggatcacctttctgtcttgtcaatgaactcttacaattgaactattagacatcgcagcatgcaatattaggtcaatgggtcctttcagattaatgtatcgtctttttgaggctgttatggagcagtcaaactcttacgagagtcctgccagtagaggaatgctgatattgagttattgcatttctccctttgctgccatgtgcatgacaactgctatcatcctgaatcgtcttactgtgttcgccatcacgcgatacagtaaccggaagttgccacggatatcgtctctgttgattcgtatagtcgcaatttgggctttgtattctagcagttacggtgtcttggttgcgctgaagacttatcagaatcacagaccccacgtcaaccttttactgtctgattcctactttttcaacaaagatctgtttgaagctgcaagattcctttattgtggttttggaaaggtaacggttgtccgaggggcagaacccaacagtgctccaattgtcttgggaccttctcctgctgtattccgcaatttttatttgggaatttgcgtcagccaaataattgaggcatttgtatcattgacaaacggacaagacccttcggttgaaaatggactgaccctgtttgaatattccgtggctttccaggagatccaaggatctcagattccctcttatgcatccatggtcgtggccctaattgcattagctaaccaactgctgatccatgttctaggattgttgaatttgaccaagtataaacttctaccttcctcagtaattgggttgtacggattatttttttttgcaactaccttttacgatggaactttcctttcacttccctacacgatttacttgggatacttcccacaactggtgacagctcttattattcttctatgcttccttatttacacactggccgtcatatttaaggggggatcatacgaagaccttcaatttagcagcataacacataattcacaatcgctgaacgtatcattgagtgatgatttttacacagctttgatgaacattggttccttcgtgatcactgtctctggtagacaaagctatatcaatgaattgtcatctattgaagtaccggagagcaattttcttcaaggtgatagtggatacaatgttcaatatttgacacacccaactcttgccaaattgcatgataaggctaaagttggcttaataagaaagaggatcaacaatttttcaaatcttgtctctcagttcgtcgacatgatcatcttactcgcattcaaaagaaaactaatcgtaaataagcagccaaagtctacatcaagtcagagagaaaaagcaaaccgcaatgcaaaacctcaagttagagaactggacattgatgacgttactgtagaccagtacacttacggcatgttactgaaagacacaactttttccgacgtggataattcggacgattacatctatgaagaaagttcgactgatgattcagattgggagtataacagtgatgttgaaattgaaacagagaattctaacccatcatttgcacaattacaacggaaatctgtttattctggtatgcagcctttccagaaacagtataatgcactatctgaactggtaggcagcgttgattttaggcatcttctctctcctgattctctttctgacaggcagcaggcacgcctcctcagcatttcctttagcaacagcagtctatccaagacccatcttacccgttcgaaattcaaggagttatacgaaaaacatccagaatggaaattgcaggatctgatttttgataaacgacctttgacaactactgaggatttccaggattcgttgggtaattgtgtcgtttgtcagagcaactcgcgtcaagtaattctatggccttgcaggtgtcttgctatctgtgaaccctgcagagtgtctttggtaatgcgaaatttcaaggaatgtgtttgttgtcggagacacgttgatggattcagcaaaatctatattccttgaagcacgtctattttctagcaatattagtgtgtagcttatgttctttaacaaaacatatactgataaatcccaatgtcacggttaccagtgcaaataagaaggcagccttacaactagattcgtacgtgcttttaatgggattaatggcccactctggagcaactctcacatactcaccattacttaaagcattctttatcacttttttcagaactttgggggaaacatcgggaggagctgcgtcttgcaacctggtaggaagattccgaatcagcactgattgaaaaaatgcagaagccagggacattcctaaagttgaccctgtcgaacggaaggcgtattggatggaagtggaggatgcctgttgttctggaggtactgcggctattagcgccagaagagttacagtcaacatggcagaataaccacagtaaggtaatattagtagggaatactgatcccaaactggaatcgttggagtaatcaatgccacatgaataacgcccactatcgataaaaacgaggtcacaattgcaaaccaaaggtacttccctgtcaatttcatgtagaaccctgccccaactgacgataaagaagccaaaaagacggagggtacaaaccgtaatccattctcagtggacgaaaactccagaacagttgtaaaataaattggaatataataaagacaagtaaatcctgccatggtaccaaaccagttagccagagatgaggcaagaactgttctattggcaagtaatcggacaggaacaatgggttccgtagcggagtaaagttcaacataggcaaataccaatgaaaaagccacaaaccccgtaaccagagctgcaaaggaccacgtcttgtaaagcaatttctgtccacctagatctgctgccagcatcgcacataccagagcagtgattagagtgacgcttccaagtacatcgattctttttaacttggattttgtatctgtgtcttgtgcacctaatccaagagatcctgaaggcaagttcatgaacaaatataccaccactgccccaatgaaggccaatggcacttgtcctaagaatacccatctccaaccatatgcatcagatatgaatccaccaacaagtccaccagtggaggctcctagggcaaaaaagatgttggcaataccttgaaaaatacctctcttacgcaacgagatcaaatctgacatggcgattgtaccaagcgttgttaggccaccagagctcagtccggtgagaaacctccccacgattaaagtggtgaatgttcctccaaaatgcttgggcaatgcacagataagacatccacaagagaaaagcagattgcagaggataagcagacactttcttccaaatatatcgctcaatttgccgaaaagtggttgaaatgcagccattgcgagtaaatatgatgttgcaatccaggagaactttggaagggcatccaaatcggaggatatcaccgtcaacaacgttgtcaccaccgtagaatccaaagctgccagaaaggcacccatgaaaattgaccccaggatgaaatacaattgtgggggagggacggcatagccagaagcatcaaactgttcactcttacgtttcttgactttttttcttcttagtgagacactaggagagctagaagtgcctacgttctcctcattttcagatgcctgtgaagcggcgccataagttgaggatacttcaggttccacacgattagtcagttcattttcggtggcaatctcattagccacaattccctccacaccagttgaagtgtctagtatattggggggaagcaattcctctgctctaaggagcgcctcgctttccgaattctgttctggcattggcggataaaaatagttcaactaagaagagcaaaggtggaggggtcgtcaagggtgaagaaaaggaggtacagggctgagatgttgaataggcatgcgttattggcaaatatttttggatataggctttcgagccgttagcggtagcccagaatatggggaaaaagaaagactggagggtctcaagcggcacgatgcgcgcagtgttgttccagctttggtaaggagaaattcggggtttctggttgcctcggccttacaagtttcctctttggctcctgtttcattttttttcgcgcaggctgacatttttggatctcgtccgggtaacactaggacacgaaaaacaagtgtttgtttacattagacaaagctaaacagttgttacaagatcaaccctttcaaacactgttaaccttccaagtattatgagagaaattgtatgtccatccaaaatccactgccaccctatttttgcactttagccagaaactaaccttattttagatccatttatccactggtcaatgtggtaaccagatcgtaagtgacttatttacttttcagaacaccgtagacatggaccttttactaacttacaacagggtgctgccttttgggaaacaatttgcggagagcacggccttgacgatgaaggaaactacgtaggagacaacgatctccagaaatcaagattgggcgtgtactttaatgaggccaacagcggcaaatacgtgcctagagctgtactagtcgatttggaacctggtaccattgatgcagtcagatcttccaacctgggaaaccttttcagaccagacaattatatctacggacaatcatctgccggaaacgtttgggccaagggtcactatacagagggagcagagttggttgattcagtcatggatgttgtaagaagggaagctgaaggttgtgactccttacaaggtttccaaatcacccattcattgggtggtggtacaggttccggaatgggtacccttctgatctccaagatcagagaagagtttccagacagaatgatggcaaccttttctgtcgtcccatctccaaaggtttctgataccgttgtcgaaccatacaacgctacactgtccgtataccagctggttgagtatgctgatgagaccttttgtatcgacaatgaagctttgtacgacatctgtgtcagaactctgaaactaaaccaacctgcctacgaggacttaaacaagttagtttccgctgtcatgtctggagttactacatctctacgttacccaggccaactgaactctgatttgagaaagttggctgtgaacttggtgcctttcccaagattacacttctttatggtcggatatgctccattgaccgccttgggttctcagtccttcagatctctgactgttccagaattaacccaacagatgtttgacgctaagaatatgatggctgcttccgatccaagaaacggtcgttatctcactgttgctgccttcttcagaggtaaggtgtctgtcaaggaagttgaagatgagatgcacaaggttcaaaccagaaacgctgactactttgttgaatggattcctaacaatgttcaaactgctgtttgttctgttcctccaaagggtctcgacatgtctgctactttcatcggaaactccacatctattcaagaactatttagaagagtcggtgaccaattcagcgccatgtttagaagaaaggctttcttacattggtacacttctgaaggtatggacgagttggaattcactgaagctgagtctaatatgaacgatctggtaaacgaataccaacaataccaggaaggaatcgacccagatgaagaactagattatgctgatgaagatgttccactagttgatgttgcagaataagtacttcaagccaataaacctgcgtgcttgattggtgggagaggacttgtggcacctactgagaagggagaagctcaactgtatttcttcttcatttactttaagggtgaagaccatttttgtcctttaatgtttctttgttttattgtttattgtttcttatatacccaaactaaatatactaatgttcagtgatccatgaaggagcccctcccccagcgagtccaagactggccccgaaatttctataatctgctacagccaggttgggatgtgaagttcatcagtgactgcacctggagccaaactgatgccacgttgggccaagacagtgaactaggggtccaacttatcaaaatacctgaatccgtcagagcgcgaaagcctaatgccagcttcaactttcagagttgaaccctcccctcccccaatacgtataacgatcaacccacaattgcacaccacagacgtttgtaagatctgatgttgtggccatatgttgtatctcacatcaattcattgccacaggtttcgttacccgatcacgccaataaagattccaacgtaatagatgactcctcccatacagaaccaattattcagataagcccaaataagtataatctaccaactgttgcaattaccaagagatctttgtacttgttcaactatcgtacctactcaccaattgctgcgcatgtacgaaaactttcttcattggaggaatatggtgagaataagaatgtgaaaattacctccgatgggttcatgtttgttgttgagacgtccaagaattacctaatggtgttcaccattcataaccttaagaatggagaggtaaccacactaaatgaagtacagactgttttttcatccaatggcacgttattgcaacaggggttccccctaatcgaaacggaatcatcctcaatcacttccttcatttcgacaatgttctccagagctgaccttgagtatcctaattttgattttggtttacgattcaagttggtgctaaaagtgcaacgtccattggttgcctttcattcccactcttctgatgttcttatgcttctatccacagatcctctctcctttcaagtgatcaaccttttttcgaagaataggacggatggaaagcatattgaggttctgttgttggagcagttggactggtatcgaatcgatcagtccgaagttaagtcgtggatttactctaagcgatggagttgttttttctggcttacagagaagggaaatatttggaaggtacgtactgagattggaccgtcaaatggaaccaccaaactagatggggtatgtttgtacaatcaggaactagaagatcaaaatgatcctaaaattgttggtctttacttgaatgatcttcaagattgcctttaccttgtggatgagaatgaaaacatacgaatctaccatcgaacaaatgaaaaattacatctatggagaattgtggaaaaaccattatctttggaaaggttaattgacatccagttttccccttctgggcagtcttttatcaccagattttttaacggttggaatatgtacagcagcatgggaaatctttgtttttcatccattgatcatagtgattcttccatcgctgaagttgacaactggttgcaatttgtgagcgatataaggtttaccccttcaaacgatttaataatatccaaaggaagcttgttttttgttgttgggcttatcaatttgaactcgtcattaaaccaatgttcaaataactgcaaaagaccaatactttacaccagcgaggaactatttctattcaaaggttgggataagaatttgactgattactttaagcaggatcccgccttgtcgagagatgctaccttgtggttgccaatcaacatacctacaaagtttatcttaaagaatctgcacattactagtataagctcggatgagagtggaacactaatttgtgtagttggaaataagtcagcacttgtttatcatgttgttacagacaaatggaagctgttcgatttgaattcggaagtcacacttcaccaagccgaatcaactagtaatgagcaaaacaataatattatagctaccggttggtggaaaaatcacctattcatggctttgagaaacatttttgatgataacggcaaacttatttcagcgtcaaaagttttggtattttcaaccttacgtttcgattccaatgatgaaaaggaaacttattttggtgccgaggagattatttggagttttgactttgaggaaacttcagttgacgagttcttgctctatttcaattgtgatgtcttgaggtcccaactaattgttgtcagttctgaattcaatgtttacacttggtcaatgagtatggaatctcacgaagaaaaaaaaacaaaaggaaggctgatcttgcaaagaggaaatgtttacagattgaagaatctctttgcagaaaatgataagctaaattccaaaagattaaagactttgaaatatgttagcttaattgacgaacacaacattgttatgttatttgaagggatcttttattgcgttcaaagatccttgaataaagatcctgaaaatcctagtttagtcaaagtcggttacaccaaagaagtgattagcactggaatagagtttattcaagttgtttccgcagatgtcgtgattgcattcaatggttgcaaatgtttatattttgatctgtgtcaagagaagaatatatcagaggtgtcacccatattcatagataccggatcagaatctgctctggcatcccacagaaacctttctaaacaccaacaagatatactgaataacaaagctttgacaataaggaagactgaagggactcaggcttatcccatattgattatgagtgaaaaaagcttgctttttggtcttgatatcgagatctcaacaagaacagttgcatttgaggacactgaaaaaaccagtttcatcttgaatttccagaccaagaaaagaaactatttgacagatttaattgaccatcaattgaaggatggtggagattttcaattagcagaagcactccataaatttgaaaaattcaaacagtttcaaaactctttagagttgctcctgctcaaccatgtgatgaattcgactggagagcgctcagacaaggatgtttattttgacaggttgcaccatctgatacaatcaacagagaactcattaggaatttacagtaattttttgaggaaagtagaagtcagacattggaaattgatttttgataaactagactcggatcctcgtaccattttgaaacacttattagagacagagaacagccacttactagcactgaattattttattatcatgctaaattacgagaatgaagacgaggatgcgaaaagtacgatatccacccaggatcgacaaatggccactaaaatcatggtcaacttgatcaatgataaagattatgaacgttcttttgaacttttcagattcatcaaactaattgatgaagtgtcggctgtggaaataactaaggaaatacagcaagagatcataacgcccatagacaaatagataaataaataaaattgaccaaattatacatttctacagctattgagctcccttcaagaacttttgtacaaatgaatctcccttgatcttgttctggtgatcaatggattcaaagtattgcatgacatgacattgttgtttccagaaattgaccagctcctggaactccatttgagccttcatatataggacatttttcagtggtagatctttgacgaatctctgtctttcaaattcttgtctgatctttgttctgacttgggaagctggaatatccaagttgtaattgttgacaaatcctctagagtgtcttaagtatctacggtataaattgagcaccagggttctcatttccgtggaatccttgacataccttgtagtctgggcaaatgcagttgggttggtcatcttatgttgaagactcctctatgtgtatgatggttcaggtgcagtaatcattcgtcgctaattcgatgagaggatattgggtgttgaactacttatcgaatagttaggaattttcaggaggaggtaggttgattaaatacgttctattaattggaatgttgttcgtttcggtcgtattacaatcgaaagctcctttagcaagtagagtctttgaaaaagggtttgactaataaggctccctttcattctatttgacggtagggcacacttcattctcagatctaacgtgactccaccaattttgaacgacgaccactgaacacagttgtaagaacgaatgacaatgacaggccacttacctaaaagcgctactcgcaagagctgacgatcctatctggactacagatgtgatccttacaaacttaagatgtctcgcaaaaccatttgaaggcacactatacgatgaaaagatgctcttgccttgagactcaaagggttactacttttaaaggctaaaaaggtcagaactcttcaaacacggtcacaacatcaactggtgctcagtatctattgcattcctaacctctatcagccttttctgcctttcgagcttccgctacaacgtggtgttaggattcgttatttggcttccatctccatctttaactccatttctgcttagctgtctatggagtgtttagtgtataaagatgcatcggttgttggatttgtcctggcgacgttgatggcgacggggatttttctctcatatgtccctcaacacagtagaatcatgaaacggagaacctcagaagggttatccccattcttcctactactgggtacagtctccgctatctctgcctttgccaatcttttactctacagtaatgatggaagaatttgttgccggttgggactgagcgactttcaatgtatcaactcacaaattggaatgattcaagtgggattgcagaccttgggctactcattgatcttggtcctatgtgtctattataccagggattcattgacggaaaaccaaagagaatacgcgcaattgctgaaggtttatcgtttctttctcttttatgcttttctgaacctctttgtcgttgtttacctcataaaaaggaaacaagatacggaaatatttgttcagtttgcaaaccttagtggagtcttttcttccttggtgggtgggtttcaatatctaccccaaatatacactacttacaaactcaaacatccaggttcgttatccataaaaatgatgtcgattcaaacccccggtgggtttgtctggactgctagtttattcctccaaccaaactctaaatggagctcttggttgccgtatttcactgctgccatggcccaaggcatactccttataatgtgcatctactacaaacacacctacaatattgacgagctggaaagagagcaattggctagaatcacagaggaaaacttagcctatacgtctttggaaaccactgatgatggtcttcttcaataaagtaaataaagagaagagttatatatgtctaaatctatacggagattgtcttccaaacattcagtccatcagatcctgtgctgaccaaagtacctggtatttggctgtgccatctcacatccttcacatctctttgccaatgaacaaaaagtagttgtggtggaatatcattcagttctttagtttcttgttgctgttgtttgatttcctcgtcatcggcttccactgccaaatcccacaatgtcactgtgttgtcctcggatgaaacagcaacaatagactcgtcaagcgggttgaaagaaatagaagttatggcagatttgtgaaaatcatagttaacaacaggtgctggagccggggaagagccgaagcttctcagatcccatataccccagtttccatcgtcatgaccagaagccagcaaatagtcaaccttggagcaccaggaaatcacattgacatctgtgtcggaggccttcacactgatagcaggcttgtgttttttagaacgagtatcccagattcgaacatatccatcggtgcctgcagttgcaaacacagttttttctgaagtagaccattgaatgtcttcgatggaggcatcagacgcaacaaatggggtgccttctgttgtccagctggatgtagttctcgaagtgaagtaaacattaccattaacatcaccggataaaagggcaccggtactgatcaatggagaccaatccagtccatatccttcgaccttgccatgatttcttatagtgtaaataggagctctggattgcttggggataacaaatccgggtgtggtgaacgctctatattgggaggcaacatcaaatagttggacctcaccgttttctagcattgatgctgtcagatactccccagttttagcagcatgaggagagactctgagtctattcgttgtactctttagtggtatgttctcgttttccaagatggggtcagaagtgctgccctcattatcctcatcgtcgtcatcgtcttcgtcctgtgcatcgtccttcactagtgtctttgataatcctgacagcttcagcaccatcaactcgttatccttgtttctttcggcttgagtaccagtagcaaggtacatcgaggcaggatatcttcttctttccgatcccatgtcatctggaagaatatcaactgtcagacaaggccatggcatgtttacattatgtagcatctcataaacactaggatcagcttccaacacttcatctggtcccagaggtttggatctatgaggtaaacaagccaccctcttgttctgcttcttcggtacgtttcctgtccttttctatgactcgctgagctttttcactggcgcctctttcatctagctcttgatcatcgtcgtcttcaccttctgaatcgatttccaaaatttcttcttcctcgcttacaagttctccttccatgtcgatatcttcaccattttcagccgagttgtccacaacccttgttgcttcaggggcagcatttggatccgttttcacagaggcaattttgttttcattgacctcctcagccgttctctttgccatattaagatttgacttttagttaggaacaatcaaagaaaaaaaaaaattaaatctccgatgagaacagaccaccgcgaaccccttacataagcatagtgtagtcagtcaacttgtagtagataggacccatccatccaatacgcttgagctccatggaaaggaaggcatttttggaccaagaacctcctcctggatatgtggccggtttaggaagaggtgctacagggtttaccactcaagcagatgttggtactggaagaattgtgcctgcaagttttagcgatgaagaatccgatgatgaggattttgtagatgatagattcaaggatgcagatgaaacagaaaatgggctcaacggtttcaaagagaaagacgatagcgacaatgaggccgatcaagtctttgctgaaattgaagagagattgaagcgaagaaataaaaggaaaaatgaagttcaagaggatgaggagcctcttgacgaaatcaaaaaaaactttcaagagttgaaaaagaatttgacttctatctctgaggaagaatggttcaacttaccggaatctggtgatttgacaagaaagaataagagggcacggttagaagagcaacagcaacagaggttttatgcggtgccagattctgtcattaatggggtggtagctgacacaatggaaacttccaattcgattgatgtcactaaaatctctgtggcaaaggacaggttactagggttgaggctagacgaacaattagataccgaagggaatgacgtccaggagtacttagactctctcaaggaacaggaagatttttcagccaagtttggagacataaatagagccagattgatattaaactcattgaggaaaacagaaccacataggggttcaagctggattgcttctgcaagattggaagagcaaagcaaaaacttttccaaggctaaagagcttatcatgcaaggttgcaagatgtgccctagagatgagaatgtttggctggaacgaatcagacttaataaaactactgatacaactctttgcaaaattattgtaacagaagggctgcagtataatgtaaaaagtgttaagctgtggttacaggcaattgatttggaaaatgaatcgttttccagaaagagaattcttcgaaaggctttagagaatttgcctagaagcgttccactgtggagaagaatgatcgaagaagaaagctcccaggaagaaaaacttaaactgttaacaaaagccgtggaactaatacctgataattctgaattatgcgtcgattacattagaatggaacagaaacataatcttgaacgggcaaagctatttttaaaagattccttgactaaaattccacagtctgtggaccttacccttctatcttgcgaaataaaggagtatgagcaaaattcagggaatgagcccaccagtacggagatactatcaattgtcttcttggacgttctccagtcattgaagaatcaggataagaaattgactttcaaggaatggttgaagtactgtgaagagtacgaaaagaaaggagaatacaagaatttggtcaaagtgattattgaaaatacggttacgtttgggtttgaagacgttccagagccagaacttgttgccaccgtgaataagattgcctacgagtacgaagggacagagcttgcccgtctttccagtctaatttattacgcattaacagaaaaattcccattcaactcttccgcatggaaaagttttatcaaccatgacaagagtggaattgaggatagattcgaaaaatgcttggataagaatccaacctgggtcgagttctggatttcctataattctactctgttgaaaaatggcaacatcgagaaagcaagagatgttttagatcgtgctacgaagcacaatcctcgggatccaaagctgattgttaaaagtattgagttttgctttaatggacccaaccgcacggagtctttggagttgattgaaaagggaattgcaaagtttcctgaacttaaaattttttacgtttacaagatcaaaatcagcgatgcattaaaaatttcatctaacaagttacttcaagtatgtgatgatggcatttcaaaacacagcaaagcggaagaaatgtacctgttaaaaagtgagattctcatcaaagggggtgatattgatacagcaagaactactttggagcagggtatcacaaactgttcacaatcactttctcttaggttaaaactatgtttcttggatgaattcaaaatgagaattatcacgagagctagaacagttttggaacttgcagtcacagaaatcaaatctgatctcacctggttcgaattgattcgctttgagaatagaaacagatcaaaagaagacgctcagattgtccttagtaaggcgttgcaaaagcatcctagttcagttctactactaatcttgagaatacaatttgaagaacgggcttccaagagaagaaacctatacatcgaggctttgaaaaaaactaatgaagataaactgttagtttctgtgattgctcacaatctatggagaagggacggtaagccagaaaaagcattcaaatttttcaaacagtcactggaatcttcagtagaaaatggagacattctgagcatatattacaacttcataaggaagaatggatccccagaacaattgcaagatttctggactacggtcgataaaatcgataaggaccaactgaaaaaaggatattactggattcaagagactcaagacttgacaccctggaagcaaaccgaggaaatgatcgaaaatacagccaggaagttggataacgacttgatatatgtttaaggtccaaggcacatggtaatggtgagcaacgttagagccgaagaggacctgactcggtcgcgactctgtctcaaatcgcggactctgttgtttgaggagtcagattgctgattacatatactgtcccgcatttctaatatctatggccttttgataccggagtcttttagaaccatcatccagatgataactttaacaaagaagctcaacctggattggaaatggatctttaggcagtcctgcaatcatcttttaacgaaatatttggtccatattgtggttaacatcttgatactactactactatatgggattgaggagttggtaaaggtgataggcataaaagtgccctcccctgtcatactaatgctgggaaattttgtgtttttaatacttttaagttgggcaagtcctaagctttttgggctttatgaaaaggcaaccttcccaacactagagctacatctaaaatggatgaacctttactttgtgccgtcctttatccgtttgcctttgagtgatgctatcagcgtaaaggaagcttttatgattatggcgatttttattgtcgggtatgtcgtgttatttgctttagtgttatgggttttgatactttgggagactctggaaaccagaactaagaaaaatgatgaagaaaaacatgaggaggaaattgaagtggttccgcccgtggagaaatgcggtgtggtggcagtcgactccagggaagatgtctgctctaacggatgttcctccgattcggacctggattccaagactgatcactcatctatagatcttctcaacaacattgtcgattatattattttttttatcatgtttattgtgggcataccattattcctcaagtttcacattgcgcttctgttatacctgagcattaccgtgctagttttcaaaaccattttggaaaagaccccaaaacgatacgccaaaatctttcaccctttaatatttacagtgggattcacttggttcttcatgcaaattttcaactggatctccaaaacagtctcatttcaagatagtctaaggctgtattctacaggaaggacatatttatatctgtttgacgagagcacataccactcgcaatggcccggagccggtgattttttggtatctctactggatatctctatcgtctctctgtcgataccatgttttagactacggaaagaattataccaaaattttatcaagttaacgagcatctgtacgtcagcagccgtgggatgcttcttcctatatccactaatatcccatcatctaggagttaaggcccctagagcccttgcatttatgggaagaagcgttactatggccctaggaaagccacttattgccaatatcgacggatcagtagatctgttttcgtgtacaacactaataagcggcctgttgggtgtctatctaggtgatcacatgatcagactcttaggatggtccaagcgtcattcaagcaacattgttacggttgggatggtgttgggaattaattgcggcgcggttgctacagcgcacttgctcaacactaatcccagggcagctgcattcagctctttaagtttcgtaatctacggtctcgtgatggtgatcatgagttgcatcccggggctagtcgatatcatccataagattgttggtttccaaacttaattttgtcaattaagtgaaaccggggccctactggtaatgcgcgaatctaaaacgagaaaaagtggggcacatactgcatgcgccaattatttcgatcgtaagatagttacggagtccttacaaacctcagactttgcgcctcaatttagcaaaccttcatgtttccggtgggacattttcttggttacatgcatgcttgagaaactaacgggatcaccctctttggacaacttggcacccttttcaatttgaatgtataacgtactagtccaataattatagcaaatatctcctttagcaccatagccgtcacacactcgtgggcttgtaagccaatcaaaatctgtcaaattttaccaagttcccaacaaaaacatgcccaggattcacgccaaaggagaaaggtagggcggacgaaaaagaaattctagattagctatatcaccttgcttaggacgcagcttctaaccccatacttaaaacttgccacgcatgcatgcaaaacaatggttcgttagtatgacctgccgtgactccgagcactatcgagtaatttcgcgcatgaagatgagccaatgatagatccccattctgtttgtcaaatagttatgtgtaccagaaatctggggaacatgtcgtaacgctggtgacacttcgtgcttacatttatttaaacaacgttggctggacttttttttttcccttgaatttcctttgcaaccccgacttttttattgcattcatttgggaactcttttactcccctttatttgttacttctttgttgtcttatttgcccacttttaatccctctggtttggtatcctcctcatccgttttacccactacacccagttcatgaaagagaaccaagcctccaacaagttcaacctcatcaagaacccaataaccgggaagccccgaattagccaggcttgtgacagatgtcgtataaagaagataaaatgtgacggaactctaccgagttgcactaactgctccaagataggctttgtctgcaaaatcagtgacaggctgacacgtagttcctttccaaagggctacaccaagaatctggaacagaagcttattgatatggagctggaccgaaacaggcttatgttagaactgaacagaatcaagaaagaaggctttgatggcactaacaacaacattgctatggcatcgtccgtctccagttctgaaaatctcaagagtgatgactcttcagagtgtcagagtgtcaccgtgagcctctcctcaacgagtggcccctctttatctccagagccaaagcaagacgatttccgtttcagagttggcatggatgggtcgtttgtcctcaatcagtttctacaatccccacttatggactacatcaaatccctgaatgtcctacagtttaacggttgtgctaactttgatcagagcttcaatgatgatcctttggtgttgaacaaatatcacatgaatctaaacaggtttttgaacttgattttttacaagttgctcctaccgttgattcacagaaactcaaacactcttaacgaaaaatttgcagaagacaacaatagtctagactcgttgatctggaagttttttacaaactacaacaaattaattcctatcttggaatttgattccttttacaaggactacctccaatttattcacaaatactactctaataatcaggtctttgttgatgggttcagaaagtatttcgagtttagcgagtttgaacagtgctttattgtcaagttgattttgattctcaagttcactctacctgttattcacgatacctccgtcccttcggaaatctatagattaatttctatggatagcctacaaagactatttggaaacatcgatttcctcaagccctcgactgacaaagtttctattttgctgttggtcttgcactatatggttctctacgaatccccaaaatctttgctggacactcaagatgaagctcagaaatatgatgagttcattggaaatttactatccactgcagttcatcacatcacttcactccgtcttcacattgacccaagaaagctacaatttccaagaccattaccatcgaatggtaatcgtctcagaatcaaactttcttggtgctacaaactgatttccaaacttttccgtgtcatttataacattgacaatgactccctctacagtttagatgattcacacttgcctgaattgcagtctatctctatcctacacgaggaattggatgtcaccattcagttcaacaacctccttaatcttattcccaacaacttccacagcttgcgggacaagcaatcgttgagtaagatcaagactcagttattggaatggcacaagaatttcaacacagagtttgtggaacatttcaatctgaacgacactgacagtgatgagctcagtgccgaaaaaatcaatgtgctgcgatccaagctaatttctctaaatcgtttgaactgttacaactcttactttcaactggtcatcgaactacaattgaaagaaaatttggatagtgtggtgtctggaatatttggtttgtccaatgagatgcttattgataataaatcttctactgaattgttgaacaccctacaacaaacgccgataattcatcaatcttcaattttggtatccctatgttacaggattcaaactggtaatttgcaggacgagatttgttcaatcttagttaacaattatgaaaaactacttcaatgtaacgatgctggattgccgatcaaaattcttccccaattggtccactattttaagggcaaaatatcaaccaatttatcaaactctgctgctcatgaagacttgatgaatatgttcactttgaatgataatctctctacaactactaccgatttggactctttcataattccgccaaagaggaaacaggaccaaacactaccaattggaacaaagcgctcaaagtctgcttccacgtcctccgttatctctagcgatgactgttcattgttttccaactcgttatctgtgccaactactttctcgggaagttctatcagtgttggaatggataatccgccaagctcgctttttggaagttacaagagaccatcttcaatagtcaaacaagaaccaacaatcaacccgaggtcaaatggcactaacaccgatagcaatctattcgatacctttaatgattctatcaaaggctctttgaataacggtttgaagaagttgaaagatatcagatgcaattctgtcgtggaaagatctcactcttcccaaagaaatgatttcttgatggatcaagaggacagtataaccaaggagaccatcaacttttctgagcttttcacctgcggaactccaactgcgtctcagagtattgacagatctcccaagtcactgctgttaaatgacttagctatagctcccgatactttggtcatcaaaccagacgctgaagacctggacagattgaaaaacaaaatcagatctgtcaaatcaactgttcactagtctcattctattaatttataaataatattatatatctgtatcatgacattaaacaaaataagagatactctaaaaaaacaagatgtacattattcatgaacttcgtaaattattaatgcaagctttctgtacgatacaactttaaaacgtccacatcatcgtcgtaagattctccttcgtcactgctgccgctatcttcatccgagtctaagcctttctcatcaaggaaaccatcttcaagttgttgagtttcgacattccctgtctcataaagtggattgtcaggtttggcataactctgtccgtcatcattagggtcttcataatcatccatgtcgttcatccatccggtgttaaacattaaactactgtctggattagatggtttcagggactcttgatctgcattctgatcctcagaaggttcgttttcaatctggaactggtggtccatggaaagttctccttcttccataacaaaattctcagaaaaatcttgagtgtcttcgccttcaatatccatgtctccaccaagaatcgaattatacttctttctgatgtccgctaaagtgcatttgacataattcagccaatcctcggtggaaacagctttttcgataacttcatcaagattagattcataggaccgacaaaacttgacaacctcttcagcgatcaaagtaagatgacccatgtatcccagtcgcagtccgctttgttcttcatattcatcgcattttctttgaccagctagaattaaatccgtaatggcactacggtcaaacaagtctctcaccaaaaactcattatagccaacagtcattgatccagtgagcaattgttgaacaatatcaaaaaccacattgtgaagaaagttgttccaaggaaacttgaaaaacatctcgagaatggttttaatcacctcattatcatacaatgcaatctttaattcatcgcctacaacattctcctttttcaggttggcttttctttttgaggcatcagtgatttctgtgacttcatcttcatccatattagtactttctttctgcccattgccattttcgtattgactatcatcaaaagtgttctcccgctgctccggctcttcggtatctgacccgtccacgttctgatcgcttaatgacatctgcgactgattcttctcggaaagagtaagattcttgatctcgtcaataccttgatctatactttcttcctgtagatcatcattaagttgtgagttggtacgaagctgagccctaacctcatctctttcctgaacaattatagctcctttcttatcattgagtaaggccatgttcgagcaatgaagcagttcggctatcaactcgcaaatcttgaatctttcaaagcctaaaggctcaattgtaccaaatggggtttccagaactttctcactttttcctttcaacatctccgtgaaagttggaattgctttgctgaaaactttcaccagatgtcccaaatatattggatctctgggattaggtggatgtgtctctatggttgtgtaaagaacagagacaaaatcgtaatccgagttgttcttcctaataatttcgataagtatgccgacaccatttgctaagcctgttccaccgtgcaacatcaactctactaaacgcccaattacaggttcggagacaagctgtctggttagatcatttgggccaatagtagaactatccgtatttgagtttgcagatatggtgatgaatgccttcaaaaagtcacccgcagctgattgcttagttgattgaacatctggaccaagaaactcaacaagagatgagattaagttctgttcgtataacatatcaataatacctgtggaacagttaggtttatctgtcgaaatcacctttagtaaaaagtccatgagaggcgtattgtcaatatgtttcatgaatcgttcaacaaaatttggttgctgcaagatgaatgtgataatttcgtcagttttcatgtctagcaattgctcattaatcttcataaaataagtagctgtggtcgaaggtaaaggtgtttgtaaatcaagaacaccccatagagaattcaacaaatctgtattctccattagtgcatcaacaatagaccaagcatcactggatagtatctcggtagacacttgagttctacgagaatgaatctcttcaggtgtttcctcttgttcctcctcatcttcacaaaagtcaaaactgttatcctggtgccatgagtctaacccttccgtattcgtgacattcataatgtgttctgattcatcttcctccttctcattgatatcagttttgtcatctttttttacatccttcgaatttccttcagccatattacttttctcacccgaggatgactgttcatctttagaaaaacccccattttgtattctttgatcttccagaaggtactcgatgagctgtgccataacagtatcgttgcaaagaaactctatcaacttggcattggaagccattaattgctgcaagatttccgggtcatctaataactcctctagagtgcaatccggcttctctagtaatgagtcgatggtagagacaggaccatacgaattgtatcgccagaatgatcctgacatgttaagcgatggagttgtagcagatttatgtataaaaaatgaattattggaacggggtaatggagtaacagtattgaatagcactccagttacttatgcgatgcctagcctgttgtccgtttctggtttcggtttggcctgattattcctttctgtgcactctaataggtctcccttcgtcgtccttcctcaaagttcttcttgaagctccaaatgcgtttcctccacaactgatggttcaaacggttgctgaaggagttatagagtgaaatgggctttgcacacctaaacgtattgtattataactacagagctgttctatcaccgtaagcaattttgtcggatgcgtgatgaatactaatggttggtgaacgacctatgatgaaggggcagaaaaagggcaccagtggagcgagcgaaaagtttaaggttaatgtcttccgtaggttcgattatgtaatatatatgccttgtgatactaagaacggagttacttagatctataaatcaccggtgtgaaattgttccagccaaactacgtaacggtccattatcatgggtataccttcggcatgaaacttgctttgcactttattcttcaacagctgggacccgtctcgttcgattgctctagagattaacttagccaagaaaggcgaaaaatctccataccacctgtaagaccatgccagagttttaacaatcagctctaggatgtaatcttggtttagattagaggggatattgacacgtaagttcagtctgcggaattcggctgggtcagtttcgtagaaatcgtatagttggagtaatgctaaggcactaaaaattgaaaaattggcacttaatgttgtcttcagcgctgcaatacctgcttcaaaattacaagagcggaagcatgaaagcccaattagctcccactctagagcactgtgtgttaaattggccccgcctgactttcgttctgaatcccaaactagtccaaccatcaagtcgtcgtacagagaaaggaacagcccatctaaccatctttcgcataatctttttgacttgaatttttcacttgcaatatctcttttgtgaggagatatagatctagatcttgttttgtgaattgtatcagatgatggtacttctaatttgccattgagaaactgtttttctgtttggctctcggatctactggcctggtcaccaggctctaaatcgttctcttcctcttcttcctgaaaatttagctctttgtggtattcttcctccataacaaataactcagacctgagacgaaggacctcatcccaaccaatctgcttagtcagatatgccagaagcgcatatgacttcttaaaggttccactatacctagtgctatggtacactcggatcaaaagtggctctgtggcattgatttcggctttgctagcaaggcctagtacgccatcattgttgaaaaccggaccctttgactctgcatcgttccaaatctgttcaaatttgccatctagtggttgaggaaattcaacatcatgaggagaaagtggtttgaaaatatcagattgtctcattgagtacattggacaagagttaagagccaataaagccgactgataatcctttcttcgaaggtgaacttttactaaagtttcccaacattcaaattcggctggggcagctgcaacagatctacttgcagaggtaagagcaagatctggtctattctttttcagaacaaatttagcttgctcattcaagagtagtgcatctcggggatcaacttgcaaaccttcatgtagaacgccaacagctgcaacttcattgttattcaaaaggtgcaattttactagcagcaggcgaaattcatcgttcaatgtaggcttctcggagattaattcttctattttttccaaagcaagatcataaagtccagttatctcaacgagcttcaaaagagagtcaacaagatagttttgaacatatgtaggttgctgtacatcattggaacatccaactaagtaccctttaggcagaaagtatatcaactccgaaacagcgtatttcgccgaagtagacgataaaacaggattgtattgacacattccaggcatatggcgtgccggatcatctgggaataacaaagctcggatcaatgaagaaacgtatgtttctctccatagtctgtcagtaacaccgctattgtgcaatgcattcttcttcctgtctccgaaaatgaaactggtggagtaattgccagcgggaaattccttccggattctcaaatcacctttcgtaaaacaattccaggaacaatacgttcccactgagttattagaggaagattttttggacgagttgtcactcaagtgaattgtcgaaaggtaggcaattggtcctcctacagtagacaagtccaatccagtgatataatgataggtaccggtttccttgtggcttgacttatgcagcctagaaacatggattaggtcggccggtcccagatctttcaacgaaggaaggatactggttcgaaaccccagtgattcaccgtaggttttttcgtgaattcttggaaccaccaccttatgtcgtttctgggaagagtgggagtttagcataaatttgcgaagcccacttttcttctccggactctgaacttccgtcattgtagaacgactttgatcggagttgaaagaataggtaacttgaaccctaagaatcgaagaggtatcggtgcgtgcacacacgtttaggtgtttacaggagatgtctcgcgaatgaccaagaattacatgggatgttagttgtcgcctattatagtgatcagttgctaagtattgagttgatgtggttggcgattctttcttggtccagattctttcctattagaactagctttcctgttgtgtagggcgagctcgagccagtgtttggactgtcgataatgtcgtacgtttgacgaactccttggaccactttgaacccgtccggaaatgccagtaaagctttagttctatgaatatcgacctctaacgagccgaatgaaccctcccaaagggcttcttggagtatgtgctcaaatttttgcaagctggtgaaatcgaagaggggcaaatcgatgcaaattgtggaaattctagaatcatgaaaacttggcttgatcgattgtatgctttctatgtctctgttttcatatgcgtgaaggtctaagatcttggataagtcaatgtccccaaattgcgtttcatatatcggagcaatgctgttgatcgttttaatccgtttcttgatgcgagcctcgtcttgttcgttgattctatcacgtttattcaggagaatgacatcggcgagtgcaatctgtaaatgagcggtcgtcgtcccgtctgtttctgttgatatatcctctccgtgccaatgtcctccaacatcgtcaaggcaggattcaacgtgctcactatccaaaacacacacaaccccgtcaatatacacattactcgctaatccgtcatctacccaaaacatattaacaataggacctggatcagcaacacctgttgtttcaagcagaatgtagtcgaaaccggccttcttggctatcaatctctctattgctgcaactccattatccttgacagagcagcataaacatccatttcccagatccaaccattcttcgtaactttctcccttatcttgaatggttagactcttttcaatttctacagaatctccaaattcgttcagtatgactgctagttttctatctcctttttctgctatacttttcagtagggtggatttacctgatcctaagtagccagtgattatcgatatgggcaccttaactgattcgtctacagcatttcttataacggagacaggattcgaagggtcaacaatcaactctcccttgatttcagaaacatcttctaccaactgtgggatatcctcatccattcttgctgacgaaaaagattcctgtgcgatgctccatgatatcctggtatcgcgaacagaagtatgcattttccagctcttccactgttagtgtcaagacgggcctatctaagtaatgatcaatctcaaactattggacttagcattgctattcctgatcgggctacacctatttatatctccttttaccaaagtggaggaatcgttcaacatccaagcctgtcatgatatgatagtttacggctttgatgatctctctcattatgatcatactcaatttccaggtgcaattcaaagatctttctggggagccggacttttaagtatagctatcaggcctttcaaaggcttgctgtccagcttctttgccaattggccaacaagactattctaccagtatttggtcaggggactattaggcttgttcaacgggctagggttgatcagaatcaggagagttctgagtcgcaatatctcaaaggaaacagcattttggtatatgatactccaaatgtgtcaattccacatcgtttattacagtagtagaacattgcccaacttcatagcgttaccgttagtttcaaacgcctttgcgttatacctaacgcacgagaatgtatcatttgctgtcctggccttttcaggagtggttcttagaggagaaattggtgtctttgccgtaattctggcgattgttagtgtccttcaaacccacaatttcgataatttcctccatatttttaagaatggtgtcgttggcaccttggcaggtgccatttgcagctacgtattcgactcctatttctggggatacaaggtaatccctgagatcaatagtttcgtcttcaatgttttagaagggcaatcaagtatttggggagtcgaaccatggtatgcttatctaatgaagtatctgccaaacttgtttaacaaatctcctttactaatcttagtgataccaggactttttctaaagaatgataaactgaagaactcaaaatctctcacactttcatcgttactgtacttggcaatcattgcatttcagcctcataaagaatggagatttatagtttacattgttccaccacttgtcatcaccatatctacagtacttgcacaactacccaggagattcacaatcgtcaaagttgctgtttttctcctaagtttcggctctttgctcatatccctgtcgtttcttttcatctcatcgtataactaccctgggggtgaagctttacagcatttgaacgagaaactccttctactggaccaaagttccctacctgttgatattaaggttcatatggatgtccctgcatgcatgactggggtgactttatttggttacttggataactcaaaattgaacaatttaagaattgtctatgataaaacagaagacgagtcgctggacacaatctgggattctttcaattatgtcatctccgaaattgacttggattcttcgactgctcccaaatgggagggggattggctgaagattgatgttgtccaaggctacaacggcatcaataaacaatctatcaaaaatacaattttcaattatggaatacttaaacggatgataagagacgcaaccaaacttgatgttggatttattcgtacggtctttcgatccttcataaaatttgatgataaattattcatttatgagaggagcagtcaaacctgaaaatatatacctcatttgttcaatttggtgtaaagagtgtggcggatagacttcttgtaaatcaggaaagctacaattccaattgctgcaaaaaataccaatgcccataaaccagtatgagcggtgccttcgacggattgcttactttccgaccctttgtcgtttgattcttctgcctttggtgagtcagtttgtttcgactttatatctgactcatcaacttcctttacggttgcgtttttaatcataattttagccgttggcttattatcccttgagttggtaggagttttgatgatgctactaaacacttcaaacccatcaaccaattggccaaacacaacgtgatgtccatctaaccaagaagtagctttggcagtaataaagaattgagatccattggtatcctttccagagtttgccatgcttactcttcctaatctgtcatgcttcaaaacaaaattctcatcaggaaaatctcctttgttctcaccatatatcgaacgaccacctttcccgtctccagatgtaaaatctcctccttgaatcataaaatcctcaatgactctatggaataaggatccatcgtatccaaacccgggtgtcatagcagcgagctggtagaagttcttcacggtcttaggaacgacagtaccgtacagtcccagcaccagatcacccaaaggctgatcgtcctgggtgatgtgaaacgtcacgaaatgcgtataaggaggttcttctatcggtgcactccaaacaccaagcaaaaggctgatcagggtgaagatcaaagttaaattcatttctcaagtgttcggtgggggaagcagtcaatacgttgtgctcttcgaaagatgtaactttcgcgcgatgtattttttcaatcgaaaaattatctgaagtgcaaagcttacgagcctaacgtctccctaaacgcttcccaacaatcactagtcgattctttggtggaatgaccaactttgtcaagcaaacatcgtttgccgtggactattgtccaagcaaaattacgaagtggatttcttcaagaactggcctccaactagtctacattgacaagccctctcctattatttcgggtcattttgctgtcgctacagagattcacaatgacagtggctgtccccataccttggagcacctgtgcttcttgggatccaaaaactatccttacaaaggagtgctggatatcttgggtaatttggctttctcacagactaatgcctggacaagcactgatcagactgtatatactttgaccactgctggttgggatggattccgttcacttctaccaatttatctggaacatctcattcagcccactttaacagaagaaggttttgttactgaagtttatcatgtggatggaaatggtaaagaaaagggtgtcgttttcagtgaaatgcatggtattcaaaatcaacattggtttcatgtttggctgaatgctcaaagagcattgtaccctcattctgcctatagatctgaaaccggaggtctgatggaaaatcttagaaagctgaataacaaggatatagttgattaccacaaaagctactatgttcctgagaatttgtgcgttatcattagcggatctatcgatgaatctgaattgttatccacaatgaccgactttgataatcaaatacccctagacttaccaaaattaaaggctagaccatggatagattcaaggcacgatattgcgccaactgagactattttcaaaactgtggagtttcctgacaaagacgaatctagtggggaagttttgttttcttggattggtcccattgttgacgatactctgaagaatgttgccattgatattatgggttcgtatctcacttctggtcctatctctctactacaaaaggagtttgtggagtgcgccgatcctttagcatacgctgtatcatattacaccgaagattactaccacactaatttgaacattgagttgaaaggtgttccaactgagaaactagactttgttgcagagcgcgtattgtcaatcataaagtcgcacgctgcaaatgtctcagagtttgatttggagaaaattaacgactacttgcaaagtgctaaatggaattacattttgtcttgtgagaatagctctgagggtttgaccaccattgcaattagtgagtttatttatggtaagcgtgatggttcagacttatctaagtggactaaagatttgtatgagtacgaaattttgcaatcatggtccagtgaaaaatggtgtaacctgctgcaagaaatgctggtaaacaacaagcccgttgttatgaaagggaaaccatcgaaggagatgtaccagactataaagtctggcaacaaaaaattattggagcagagaaaagctgaccttggagctgaagggttaaaaaaggcacaagatacacttgagcgtgctatcaaaacgaatgatgcacctatacctgatgatattttggactcgttttcacaaccggacccttctcgtatcaagttgttgcacacagttgcagtctcttgtggaacgaatcaatatgctccagttaccgaagagaacaagaaattgcatgaaaaattatctcaagaaacaagactggaagattttcctctgtttcttcaatttcaagatattaaaactcaatttgttagcattacggtgcttgtaaacacttttaacattagcaatgttgatttaaagaagtacatggaggttttcacgaatcttaattcattgccaatcgaatcggagaacggagagtatctatcctatgaggatgtggtatctggattaaaacgagacacaattagtaaccacataaactacggtatcggtggctcttttgaggattatctgaatattaactttattgtgaaacgcgagaattacagtaaggccatagaatggattcacaaattgatgtaccaaaccaagtttgatgaggatcgtgttagagttactatagagaaactcgtcaattccatggcagaactaaaaagaaatggatctgaggtattggattacctgtacaacaagaatgtgttcagcgatgaatctttgaaaaaggctaaggatacactatatttagaagaattttacaaggacctgttaaatgaaatcaaatctggaggattttctgcgatcaatgaaaagttggaattaatcagaaatcaaatttttaagttagagaatattcgtgtcttggttgttgctgatgttgaaaaattagacaatgctgtcaaccaatggaatattctggttgaaggtagaccacgtgaagaaccaacaccggttccttctccttcaaaatcactttcaagcattgggactaatttatctaataaggcatttatcgctgttactccaggatcagaatccacgtatctgatgtttattacaaaagtgcccaataagtattcgcatgaggatgtgccaaaaattgctttgacagcttcttatcttcaagctgtggagggtccattttggagaggtatcagaggagcaggtctggcttatggaaccaacgtccatcaatcagttcagatgggtcaactagtttttgatgtatacaaaggagccgatggaccaggggctattgatgttgcaagaaaaattgttgatgactatgccaatgggtcaatagattttgagccaaaactaatcaaaggtgctgtcagtgccattgtccatgatattacagaaaatgaaagcacatacttccaagtggctcaaaatcattacattaaccaagttataatggaacgagggtctgactactatgaacagtatttgaagaagttagccaaggttacaaaagaggatctgttctattgcattaacaaatatttcaaaccgcttttcgataagaactccagtgttgttttcggttgtgttcatcctggaaaagctgaggaactgatagccaaactagagaatgaatttggatatgacgtgactgtcgaaaagattgtacctacgaacacaagtaatgaagatggtgacgttgaaatggaggatggtgatgaagatgatgaagatgatgaagacgagtctgacgatgaatctgagtattcgtcatcagacgaagaggacgattcagattaaagacacacagtccaaggtgctactgaaaaaatagaatagaaaccatatagattatcgatacgctccgcaatagcttactgtacctctgtgatactatcatcagcatctagtccaaaacaccaaagacgggggctacgaaacgtttcttcagtcactgttttctattcagcttttactatacagttattaatcgaggttctactacttactctcccaatattcccttcagtgcctcgtcattaaacaactctccatgctcttttaatagtttggctatcagaaccaatgatttttgagtgtgaaaatcatcactttcttgcagctggttgatttcattcccgtattgtctaagttgcaagttcaaatacttgtctagtagttcttctctgtatgtgttcaatttttcattggtttccaatttggcttcaaaatctatattcttatccgtaacaaagcctaaactgtttaaaatatccaatgttgaagcatcctttaaagctttgttttctttactatcggcatcctccattttaacatcgtatagttctacctgttcgtcagctctaggctgatctgagggtttttcctgaccattttcattttcattctcattctcactctcactgctactactgctgctgctactactggagtccgattcaacttcagttcttctcttctttctcctcctgctactgacagacttgctcttccgagttccagaatctgacaatttacttcccattgtggtctagatgcgatgcaaggcctgatatattttttttttattttgtctacttcaatccagcgcgaatgttgtgtagtttttcttactatatagccttgatctaagcaaaaagctcaacgcaagaatcctttacgggtctttgcaggaggttgggcatgtggttcttggtgcggcgtggtcttggtgttctctaacatcttcttcttctcttccaaggttttcagtttcttcaaaaacttggccttcatctccttgtgtcttgcaatcagttctgcctcagatttctgtaacttcttctctttatcagcaacttttttctgcaacacagactccatgtcggcctccagctttgccaatgcagcttcttgcagagcacgctcttccttttgtcttctaactggatcaaactcgcggaaaacgctgtcatcctgtgtaattccggtcttgagaagtttctcagttctgtagttctcatacaaaacttttgcggtatgttctttgagatcctccatgaaatctctaatcaacagttgtctcagtttgatgaagtcgcagtgatcatcattgtccacttcgataaccccccaggggtaggatctaccgcggacagtacggccatcagcggtctgtactttttgagtggagccaacaatagcaaatggaatcttggaaatcatttctttggtgatctgcaagctttcttcgtcgtcaaggtcttcatattgaggaggttcgaagattttgatatgttggtttctaatatcttcgagtattctttgcttgaacccgtagatctcttcttcggtcaaagtgtcggacttggcaatgacaggaataaggttgaccttttcgtggacgcgtttcaaaaactgtatatccagagcagtcaatgagtgtccagtgggttcaataaagtataacaacgcatggattctgttatcaactatggttgttctgttgattctggtctcagcttccagaaagatgttaaatctgttttcaatttcctccacgattggtttccacgcatctatgttgttaatgcagtctccaaaaccaggggtgtcgaccactgtcaggtgcaatttgacaccattttccacgatatcagagctagcggtctcaatggtaacttcagaaacttcctctaattgctctgcagtttccaatccgtcattttcaatggggtacaactctttgttaaaaagggtatttatcaatgtagatttacccaagcccgattggccaactaccatcaaattcaggttgaatcctctcttcatagacttgcgatgccattgtttgggaagactggcaaatccaacgtagctggtgagtttccttcgaataatcttcaaatcctcatgttcaatttcaataccactgctgacctttggatcaacttgcacgtcacttttctggattctcaaactttccaaatcgtcttgcagttcgtgcacgttcccgtttccttcaagtgggggaaggtgaacctcatcctcggactttgcttggacgctagtttcagacattgtcatctttgagttaatgaacgagcgtttgtgtaattgtatttttaattttaatgtacgtgtgccagcgagcacaccgacgatctgggcgtcctgttgcgagagtgcgcgcgtgtgttcaagtcagattagaggggtacactatgattttctcgtctcgcgatccttccaaaaaagacgcgtgtagataggggctagacacactcaccagctagtatggcattgtctaatgaagttgaggcattggtgaaccaaggagtaaaactactggcttctaaaaagtacgatgatgctgcagagaaattctcgaatgcctgcgagttgcacttgcaagagactggcagagatgatgcaggattgctgtttctttatggtaaggcgctctttgaaaacgcagtttccaagtccgaaattctaggtggtcaatcagaggagcaggaagaagaaaaaccgcagcaggatgatgaagctaatgaagttgggaaggatggaacaggaaacttttcattcagtgaggacgtccccctcgctgaagctgatgaggatcaagtagtagcagctgaagaagaagctgaagacgaagttcaacaagaagggccaaaagatacaaagcatgatggtaaccaacagagtgcctcagaagagcacgaagagaatgaaaatgtgcctaaagaggattcggaatttgatattgcctgggatgttctggattccgcacgaggactttttgaagagcaattgaaacagcatccacaaacggtacctgatgttcctcctctgaagggcgtcagagatgagccaaaggatcaaataaccaaaatcaaaaagaatttggccgatgtttacgactttttgggtcaggtgtcattggaaactgaaaactttgctcaagcatccatagattttgccaattgcttaaagtatcgtaaagaattataccctgcatatagtcagctcatcagtgagtcccattacatgatctcactagcgctggagttcacaaaagaggaaggagccaatgaagaggagactttaaaacttgaagagaaagccaggttacaggcagttgaacacatgaaacaagcaatatcatgtataaaacagagatacagtctgccggaaaccacttcgaaagatgaaaacttattgcaagacatggagcaacgactccaggaattggagagagacccactgaaagagttggagcaacaaaagatggacattttaaaaggaatcctgggccaagcaacttcaaactcatcttccgaaaaggaacaggatgccaacaagccagtcaacgacctaacgggaatggtaaggaaaagaaaagcgaacgtcaaaaactcacctaacaaaagaacgaactaaaaaacatataataagctaacaacaactaaataactaaccgttaagaacagcctcacttgctttgttgtaacgaccacctttgattggaaccgactctgcaaagtcagtaatctcctggaactcgctatcagtcaaggaaatctcttttgtgttttctgcaactctacgaggagatgagcagcttggaataggaagcaccttgacgtgtttatctccaaactttcgtaaccacgcaagagacaattgagccaatgtgactccttttttgtcggctatctttttcaaaccgtgaacaagtttcaaattgtgttcaataacttcatcgtcattgaatctttccaaacttaacctgatatcaccttcaggaatgtcagctttgctgtttatcgttccagtcaaaaatcctcttcccaagggactgtaggcaataataggaatgttcaaatcctcacaagcagcaagaactccattatgaagaatatctctagtcaatagagaaaactccacttccacacaggcgatgggagccactttcgcagctcttctgatagtgtcagcaccaacttcactaagtgaaatacctccaattctgccatcttcgacgaacttagagagattctttattgtctcctcaatggagtaacgtttatcgattctagcaggctcaaaaattggcaggaagttgttcggcaaatgtttggttatgtttgaaatcgatttttcaaggttctccggggaagaatcggggctcacatcgaccaaactgacagcaccttttaccgacagactcacctttttatatagctcggggtacctttttgcaaattcctgaatgtactgcaaattcaggtttgaatcaagaggaaagttgtagaactctcctccgttcaagtatctgacaccagcttcctcaacagcatatctaattgtctcaattgcatcatcaattggggttggagttggtttccaagtaagattcataaggcctaagcctgtaccaccttcgattgcaactaccatttgagttcaataaattgtccgggaggcctcaaaaacatgaaaattcatccccttttatagacaacagtgggccttacgtcatgttgccaaattcgccactgaattgtattaattactaagactatcgatgttattacctcaatcctgcgtatatttatggcggggtgactagctgcgacgcaatattgtgtccggaattggctaccgcccccctcataacccgaagcttaatccgtccggaacctgcaaaagaaaaaaaaagtaccgaaggaagctttccctggctggcctcacacgcgaaactacctgggacttcaaacggcgcagtttttcctcctttgcttaacaaaccctaaaagcaaaactccgactctttagcaacaatggcttcaacaccatcttcaaataaaaccactccaagcaaatcaaatgcttctaccaatcccaccaggagctcaggaaaaactgactgggtgtcgttattccagactcttcacttcgcctggttcttaggtcatgtgctaacgttgctcggaggtttggggtatcttctgactattagaagctctggagcaatcaattcgttcttctacaacgctgtatttgtgggcgctgtcgagtctttcggtgtccttttgttccaaagctataccaacaagactttgtcgttgaaaccactggaccttttggctttggagaatattcagtactttgccattgctgctttgttcttgactatcctcccccatattgcaattgctgttgttccatttaccttgttcagtgtgtttcacgctctgtcatatacccgcagcaacattctaccattattgaatatcccagcaaccgccaccgttagctccaaaattgcggactttgttaagacttataacgacaagtctttatttttggtgtcaaatttcgaattttttaccctggccattattttagttaaggctctgctattcagaaaaggttactggattgctgccgctatttacaccgtcttctttaagctacgattcgaaaaatctatctttttgaggtcagtcgtaaagtcttgggaagcaagaattgatggtttagtctcacatccttccctcaacgttgctgtcaaatctaactgggtgcaggtgaagaaactgattagaacctatggaggaaagccaatcctggccactacggcttccggttcgtcatcttccaacccatccactccacagaagaatgaataaatttttttttgaagcaaacctctaggtatgacttttgcttccttttgtttgtgttattattattcctagtatgcatttttataacacctagttttcaatagttacaaattataccctatccagcttatctaacggtgtcgtcatagcacagatcgctagctaatgttgtcgtgctctactcaatatcatggatcttgcatcgaagcctttagaacttcatggaatttacaggcatgaaaaattggcgagaccaagatcctataaattaccataatcccctaccatgcatttcttctctccttctttacaactgtcagttttttcacaaatagacataataacataatatgccagctgtcggtattgatttaggaactacatactcatgtgtggcacatttcgccaatgatcgtgttgagatcattgcaaatgaccagggtaacagaactaccccatcattcgtcgctttcactgacaccgagagactgattggtgacgctgctaagaaccaagctgctatgaacccagccaacaccgttttcgacgccaagcgtttgatcggtagaaagttctcagatgctgagacccaagctgatatcaagcacttcccattcaaggtcgttgacaagggtggaaagccaaacattcaagttgaattcaaaggtgagactaaggtcttcactccagaagagatctcttccatggttttgaccaagatgaaggacactgctgagcaattccttggtgacaaggttaacgatgccgttgtcactgtcccagcttacttcaacgactctcagagacaggccactaaggatgctggtctcattgccggtttgaacgttatgagaatcatcaacgagccaaccgctgctgccattgcctacggtttggacaaaaaagctgagggtgagaagaacgttctgatcttcgacttgggtggaggaactttcgatgtttctttgctgtccattgaagacggtattttcgaggtcaaggctactgctggtgacactcacttaggtggtgaggactttgacaacagattggtcaaccacttcatcgctgaattcaagagaaagaacaagaaggacttgtcttcaaaccaaagagctttgagaagattgagaaccgcctgtgagcgtgctaagagaactttgtcttcttctgctcaaacttccatcgagatcgactctttgtttgaaggtgttgacttttacacttctttgaccagagccagattcgaggaactgtgtggtgatctattcagatctaccattgagcctgtggagaaggttttgaaggacgctaagttggacaagtcccaagtcaacgagattgtcttggttggtggttccaccagaattccaaaggtccaaaagttggtgtctgacttcttcaacggtaaggaaccaaacagatctatcaacccagatgaggctgttgcctacggtgccgctgtgcaagctgctattctttccggtgacacttcctccaagacccaagatttgttgctgttggacgttgctcctctgtccctgggtattgagactgctggtggtatcatgaccaagctgatcccaagaaactctaccatcccaaccaagaagtccgagactttctccacttacgctgacaaccaaccaggtgtgttgattcaggtatacgagggtgagagagccaagactgccgacaacaacttattgggtaagttcgagctgtctggtattcctccagctccaagaggtgttcctcagatcgaggtcactttcgacatggatgccaatggtatcttgaacgtctctgccgttgagaagggtaccggtaaggctcaacagatcactatcaccaacgacaagggtagattgtccaaggaagacattgaggccatgatctctgaggctgagaagtacaaggatgaagatgagaaggaggctgccagaatccaagctagaaacgctctggagtcttactcattctctctgaagaacaccttgaacgagaaggaagtcggtgagaaattggatgctgccgacaaggagtctttgaccaaggctattgacgagactacctcatggatcgacgagaaccaaactgctaccaccgaagagttcgaggctaagcaaaaggaattggagggtgttgctaacccaatcatgactaagttctaccaggccaacggaggtgccccaggtggtgctgctccaggtggcttcccaggtgctgccggtgctggtgccgaggccccaggtgctgacggaccaactgttgaggaagtcgattagatgatatgactccctatcctgaatcttttagatgttgtacattacatagaagagcttaattctaatttctccatatttacctttcattgtggtaaaaataaaacgtaaacaataaggcacgaaacgcgacacattctaatgtgacggatgcgattttctgtaattcccccatgtaacaatccctttgtttgacgaggcggagtatataaaacaccaaaaattctcgtgtgtttcgtgttgtcttgaacccattgacctaattttacatgtcattttccattgtatcctctagggactcccgtgtgatgagtgacatggaatcattgaccttgaatcaacaaaagaataagcgattgtcatttgaagtggtaagctgcagaagctcacaacacgttgtcagccctgcttatgaacactttgtagaggggtatttgaaagacgttgatcctgctaaggaggctgatacaccagaagacgccaacaaattggaaggtgatacagtccttgaagacgcaaatgaaagcccaaaaagtcagaaaagtagggctcatagcaatcatagccatagtagtgtgagttttcatgaggcacaatccaatgaagaagagttgtctcaagacttgcaaattaaccaggacatgactgaaagcaatccatctctagatgataaccaagaagtggtctccttggagagtctaccaccaaaggctagtctaactgatctgccctccaaattactggatattatcgccagtttccttccccaacagtcagctataaatttgtcacaatgtgcaaagaaattgattcccagcacaaggaaacgtttgctgcgaaaagtggtgtttgtcaattcgtggaatgaagcatgtagtttgcagagagaactcaactcaaatatccctagcaccattgtttcaatggaaaaaatgattccctttttcagtaccattagactgagtagcggcaacttgggttcattggtcaaagaattgtggtgttttgcctcagtgacttgggaatctggattagagttcactatcaatgattcctggtttttggttgctcaacacctaacaaacatggacacattgatctggccacagctgcccatcctgaagtattctatcttacctttggctatacgtttgaaaatcaaaagtttgtgtgtggggatttctcagatcaataacaacaaccttgtgagtttcgacaataacgtgttgagcttccccaatcttaaacatttagccatcaacatggatcatcccaacggaagaattgaaaattcagaactggtgtccaatcttttggtgtggggtgggactctggacaacttggagactttggcaatttctggatctctgaacgaagttttatccaagaatttggtgttccatggagaggaatctcgtaaaccaatggtatcggttgtcaaggaagaaaagtttccagaaaaacccaaagagcctgtaaaagagctgccaaggacacctgtcctccagcaagacacttatcgtattccacctcctccagaatcaaccactgctaaaaagaataagcttcatgttaatttcactgataagctacgaccaaagagaagagtacattctgaagaggatcctgcctcagtggaaccatctgcgttcaagcctttaagcccagtgataaacccagtaccggctgcagcattcccaatttcgcagcccagtacttctcctccccagcaagctcctccctctaacccaactccaggtagcccattccagcagcagaatgtcaaaccccctactcaatctagcttggccttagacgatttgtcaatcagcaagatctggtccagctcattgaggcaaataaaaagatttaataaactgagaatcaacaccctttctttggataagatactgattgactccaacgatattaatgttttgtttgactgtatcgagtttggaggcatcaaacgtttggaaatgaggaatgtcgtccataaatataacggacatgtaaatactagttccatcagcgcaggagaccaactgctgctatcatttatgtttgagctgggaagccgattagaaaaggtcgaagaactatcactggatatcaagttcatgtgtagtcattgtcacaaagattgccagttactggaaagaaactacgttatcaagtttttgaatcaacttccacctttgaaatcgattcatttgactagtcatgaactgcgcagcttaaatgtaaaacacctttcaaagcatacgcaatcgctgaggaagctttcgtttagcaacccatctaaacttgaaaagttgatcattgcgttgaagcagcaaggagagatcttgaacagtttctgggaaactggctccggtactaggattgatgagaggctgttgacccatttcaataacaatgtggctcgtatgccgctgatcaatgacgtgtttactccatctttagacacgctaaatgatgatctgtctaactacaaaagaaaactgttttccacaaacaagtatcaactactaagtgtttttggactgcttgtcgatgaatatgaaacctccttcccactactaacggacttgacaatactcagttatcgctttgagttgaagtcctccaggattcgaagaaatgccgagaaatttgataggagtaatctgagatactccacaatgtttggaaagcccaacaggcaaagaagaatagttaccgggtgatattttcagaaccaggagacgtatgtctcactatacccatgattactgatcgttgtatattaatgtatttgaacgcgtaatgataacgaatgtcccacagaatgtaggagaaaatgctaccgactaaacggcggcctggacattttcgaacattttctttctaaaccacagaatgtttcagataccatggactgggcattattatctgaggctcgaaagttcccaccatattttttcccgtcctctatctataatcactgactgcatctgccctcacccaccaacgatcccacaatctcattccaaatgtctctaacagtcgctgatttgaagtacttggactctgctcaattgtaccagtggattaaacaaaatgcttcatcgtcaggttcaaagtttttggtggttgatgttagagattccgattacgtaggtggacatatcagaggcggattgaatgttccgtcctcaacagttaagtctcaattggaacctctgttcaatcggttgttggaaaatgatgtcaaagacgtagtgttccattgcgctttaagtcagcaaagggctccttcctctgctatgctctttattagatatcttaaccagcagaactcggatttgaccaagggtcttaaaatatggatcttaaaaggtggtttcgtcaaatggcaggaagcctatggtgaagatgactctgtaacagaagcttacgaaaaggatatctggagatatggatactgatcggtttcatcctaacctttcctttgcttcttactgttcttagtcagtttgtcggtagcactctttagtcgttttcccatcgtaagattacggcgcttttgaagcatttctgttgggaaaaactctcccaaagtagtttgcttcttcttattcatgtccctgataacaggaaccagcacttcgtcaaccttcttctgatcccacccaacggttgccatcagaaatcgtcgcaactggtccaggtcaggagttccccactgaaatttggtatcatcactgtctacttcaggtctcaagtatccttcgaatacttgagggtcggggaacccgaaatctaagaaaagctttcccttaaactttctctttagtttagttctgatttcgctttcattggaaggagcaggaactccattctgataatccatccaccagttacgaaaattgatcagagatccgcttcctaacatgttctttggggtgctatttccctctttttggggatcaaattctgaaagaatttccatggctgtcactataccaatacctttgattccttctgtataatcgcttcccactagtaatgctatttctatcattttgtttctggtaagacctaaatctctctgtatctcttccaaaaaatagcattcgacatattgcttctcgttaaacatgttcttgtaaatcctttcacctccaaacaagaaacaatcactatcatccgtaataatcccatccactagctttaatttaagcaattcggcacattgggcttctgcctccattggtgctgtgatataaggaataccaaatctagtcagcatgtcttggatgtcatcgatcattccttgggtaacctcatccgaatctctttggtcttttttatgttgttctttcatttttgaatcataaatgggaactgttgtattggaggttgtgtacccatactgcttctgcagatcgcttgcgaattgctcgtgttgatcctcttcttccatcatctggtccgctaatctttcttcctctgattcagaaaagtagtaatccagtaatttgttgtcagcgttggctggttttaagttgttttcaattggctgatcaataacttcgtccttttcattcggtgaagctggcagattgtttggcttattttcaaccgcattaccttcttctatagatatgttctcttttaccggctcatcatcatactgtgcgggactttccagatcaaccacctcggcttctttagcttctggggaagagttgtcttcagattccatattttcaatttcacggaatggaatcagcccagctttttcatcatcgtttggatcaactaccctgtcctcgttaaaaggaacttggtttgaaacttggtcaactttattatcgaaccaagatggtaaaggttgggccttttgttttacttcctgatcaaggtcaatatcgtcatcggacgaaattggagatgccactacaaactctgattcccgctcctccttcctttcttcctctaacatctcctctttgctgttgttcttctcggcaataatgtccttctgcaggacttcaacttgttcgctaggtttattgttgcctttaaaaaggaatgactttccaaacttaatttcaggaagattcttttcagctacctcagtttctgaaactggtttatctatcagtatcatattttcatcagttgaattcttcttgaacattaattccctttctttatttcgcaaggcaaagtaatcatctttagactcttcaactgcttttctcagatctaaatcgtcttgactagtcaccgaggtttccttcacctttgtttgtttgttctttttggccatttcataaagcgactggaccaaagcctggttgtactcttcatcatctgactccaatgattcagtctttgattgctgctccacgtccctggtatatagttcttcatgcgtgaatgctgactgcccaccatgaatacttgggtccataaatgattttcttggtaaatcttcctgcggtttcaacagaggcaaattattcaccttgtctaacggtacctcatcccatccctcttcaggaaactcttcgtcttcgtcttcttcttcctcgtgttttatggcagtggtttgttcagttttaatgacgttaccataatcgtccagttgaattggattgctcgcagacgaaccgtctttggcaagtgccaaggtccagccttggtcattcttttgcaaagagtaacttttatctacatcaccagcaattcttctagttatctgttctggattcgtagcatccattcctgacacattcataagtttctgggtaaaatagtttcttttttgaacttgctgtatctgaaatttactgaaatccatgccgttagggaataaggtgttcagttgatttttagtgtaacccattctcaatctagaccgtaatctcagatgagataaaataatatactgtactgccaaggggagagccaaaaactcttcggatgatggatcaatgctgtcgagatcaatactatctatcagctcttcgatatccgcagcttgttggtgagcattgaaattaatcatcattcttttatcttcagcagaatactcaaaggcatcaagttgctgcaagtgatactcatcctcctttcgaaaagatttgggctcctctgacttggccttacttggctttggagcagggttcaaataatcgttgtcttccaaataagactcaaaaggagtatcatctttctttgttttacgcttcgatgtcagtgaatctgccttattctgcaattgggttgcaagcaacctctttgcagcctgttcaaccgtttctctttttccctctcttcgctctcgtcgcttggcaatcgttttccttttcaagatgggagcgccaccgtcaaatacaaacactggttcgatgccaaaaaacagcagcttgcaaatccttttgaagaaaccaacaatgtgagagctggcaaacgctcgtccttctttatctctcaccgccttcaagaactgatagatccagattgacgcatcaacggcaagctttttcctgctcaaagcctccaacctaacaggccttgcggttggtcccagaacattccacaactgatggacacccatatccttagcccaacctgatggaaaaacggaaactaaaaagagaaatgtctacagtgaaccgtacttggaaactgactaaaaggagtcgcgcgatgttgagcctcagcatcagctcttccctaacaacatttcccatgtggtagtgtctatctgtggattcttaacaaatggccttgaaggtagtcagtgctccgtgtccttgctctaacacaaaccaaaaaggaaggagaaataaacgtaactaccaccaactcagaacaacatatcctccaatggaagaccgtcaaaaccaaattgtaagttggacctcaataatcggtgggtggatttaactaacgggccgtctcttttctagaatcccgccatgaccccattcaacagacacatctatacccctacaggaattgcatatccttgtgacaacgggaactatggcccgctgtttgtaatgactacgggaaagactagcaatgtgccctttcaaggctcaggatctcctaacaatgttaatggtgataactcagcgtctggcccctcttacagccacatgatccatcatcctatacatgtatatccgttgaatgcaggtgcagcacaggaacccttcaatttcaactcaatgggcatgggctatgtttcttccccttatcagcagcatcctgggttctgtagtgacagcgatctgatcaagaaaaaggagtttccagaaagcttcaaccccaagcagactcccaatatgccgcataaagaaaaggttaacaagtggctggtgggattgccctaccctacgggaaatggagagaatgatgacatggaccaagatcagatcaaccccaggatgaatatgattcggtacagagagttaccgactagttactccgggactttttcggataacgagcccagtagtcttgacgattgcattagtctcagcgactacagagacttgttagagttgcaagcccgcaaactctcctactatgtctgcaaactataccataatcaaccagaaccagagtcacatgacttgcaacagcaggaggacgagttgaagatgagggtgaatgtatcctacgagttatcctctttgatgtcatagagcgggatcaggtctgggcaaagggcatgagcatggttattggcattggcgatctattggtgggttattactggcaatggagagacgaatcgcaggtggaaggtaaatttatgttctatagggcagcgaaaaaaaccactcctgtcaaatatcaatatacaagtaatcttagtaggtgtttcctagtctttggcattgaaccaaaaccaaacaaaagcggcaattttaacaacacaatgcctgatactgaacactctggtgacaccacagttaatcaggtggaaacaattgtaaccacagtggtggtggaacaacaagtaccaacgttggtggccctggactccctgatcaatgagaatctgaaactggcttccgcatcacagagtagtggttggggctttgctcatggactgcttgtcggccaattgagtgtggtcgcagttctggcatttttcatcaagttctttatatttggcaattcaagcatggcgaggcccttgatggtggctcccctcataaatagaaagccagcaggggtctataagaagggaagggcgaagtcttttagtgaagtagaggattacgattcagaaacttctagtactcaaatattagataaaacctactacgatgtcaaaactcatcaatcagagagtttagattggttcaatgtattggtggctcaatcgatagcccaattcaggtatgaagctttgaacaatgacaacatatatcacagtctcagtgacgctctatcatccagtaatctaccagactacctggacaaaattaccattactgagataaatattggagatgatttccccatcttcagcaattgcaggataaaacactcgcctaacaatagcaacagattggaggccaaaattgatgttgatgtagctgacactttaacacttggtattgagacgcagttgcttctgaatcaacctaaaccttttactgctgtgctgccagtacaattaagtgtgtccatagtgagattttcagcctgtttgacggtttcattaatttcaactgcagatgaagagtttcaatcgtctatcaagtgtgtagaggattctgaaaatgcaattggagattacgaggatgatgatgatgagtttggtggcggtgctgctttaatgttctccttttcgccagacttcagactagagtttgaggttaaatccttgattggcgcaagatcgaaactggaaaatgttccgctcataggtaatctcatagaagagaagctaaagagctggtttctggagcgatgtgtggagccaagatttcaactcattgagttgcccagcatgtggccaagaaagaaaaacacacgcaagcccgtggatagtgaatctgaaacagccgttgattctaattaatttaaaaaggatcttcatacggatcgtcttcatcgtaatcatcatctttctcatactcgtagacaatcgcacctcctgcgccgaaggactgggcttccagaaagggaagatcaacctgctccttagcctgttgctgtctagaagaagtcgtaagactgaaggtagtcaaagaccgcagcaaatcggcctctgtttggggctgttgttcgtccgtatctttttcttctgtgaatacggaaaatgtatgagactgggaatcaatcttgaacttatagatgagagccctccccgatttccgacgattagtgagtatgagtttataagtgtctctgttgcaaatgtttctcggaagataaagcttcgataggtaagactccattacctcctcctctatggttccttctttattaataccattttccaccacgttgatggggctgatttcgaatatactagaggcaataaactgcaataaagacaaagcaggaggaatatcttttaactcactctgtgcaggtgatgtgcgaggtatgttttggtgataagtgccaaatacgatcgtttgtgggtcagcaatggacctgataaacgaagctagttcctcattcttgatgaaatttaaactgtcaatcaacacgagtttcttcgacgttgaatccttgtgcaatttcgaaacgttgttggaaatatcttgaatggatctttgatcacatctcaaaaagtcggtggcaaaactgggagcgtttatcgtttcaaaagacaagtagattataggtgtctccttgggaaggcatcgcacaagctctctggtgaagtgaaacgacgattgaaatagagaatctatgcataagagaaaatgtgatggctcctttaagcttaatagcctattgagaagaaccaacgacggctgactttgggccatatctaaaagtcagagggatgaggaagatcaaggatgtaactcacccacaatcatgcgaaaagatcttcaagtcggataatgttcggttacgtaatcattagctgaatatctattgaaataaatcgtcattatatataggcttttaaaaaggtggaaccatgatcatatcattaacaatgaaagaactgagaacggtattcctaccaagtacgcagctctgatttgtaaaatgttcctgtcggctccgttggatgcagaaacctctggggagtgggaggaaacactagacgttgcggctgattcggctgcaatagatgagttcctagatggccctgtcgtggttgaatgtgcggactgagacgtctctgatacatgagatgatgttgctgtgctttgcgttgttgattccgaagttggtcttgtggtcgtggactcatgtgttgtagaattagcacttgtggttgtggaggaacttgctgtagtggaagatattactgaagaagacgattctgatgtggacgaagactcagaggaggaggacgcagtggtggaagaggatgaggaggaagttgatgaggaagatgatgatgatgatgatgatgacgaagaagacgacgaagaagacgaggagctctcacttgaacttgtgtcgtctaactcttgaccagagacaagaagagcaaactcctcgttggcttggtcaactctgcccaaaacctctccaccttcagcctcaatagaagtccacgcacctgattgatcagtgtatttgtactcagtaccagaggagtagtcagaaacaaccaaatgtttgatgtgcatggagaatggagcctgagaatagtcagtcaatcctccagcccattcgatagttcctggctgattggatggatcaccacctgcccagattccagttctcaggtacattggactctgagggtagccactactagtatcgttggccaattcacgaataacgtttccatcaaagtagaaagttaacttgtcgtaattccagtcgatagtgtagttgtggaagttagcagttggatctgcgatgttatgatatccaccacggtcataagtggtgacgttacccttgctaaaaaagttggtttgcacttcatatggatcacctccaaaccattctagatcaatttcgtctaggtcgtcactttggagatagaaggaggagataattccctgtcctgtagcggccttcaaaaccacctcaactttaccaaacataatgtagaagttcgatttcaaagaggggttgtcccaacgttcagcaagagtcaacgtaagaccatcttcgtcatatgtgacttggtcttcgaaggaaacaatgtgatagttgtctgatgctgaggtgaaatcatcggaaattgacgtggcaagagccttgacgggaggacaatcggctgtcaacagagggttacactctgctgaagtagcagtttccctctttacgactggtgttccagctgggtttgaatcggccacgggcaaggcattcacctgcaaagcggtggcgattccggtaactagtagtcttgttaaagaaaccattgttattggacgagtttatgtgtgacttttggccgtgaacgaaggatctttgtgagattttttatatccaggacaaaactattaatagtcggtacaaataggatggctggtatgaaatatgtacaatgcgcgcgttgaaggagaatcacgcaggtgccaaggtgatggcagggggttgttgtggtaatgcaatgcgcgcatgattccgtgccagagaaaaccacacaatagatcaagatgacggagggggtactcgcgaaggtgagcgcttgggggctgagttcccttgggttggcgctgcagagcttctagaatggcatatggttggtctttggtctgaacttaaaacttgactatctgtcattgacgtgctaaaaataaattgcgagttcaccagctctgcagaccgatcaaatcgagaaagtggcccactgcatattgacacttgaccatccatactaatcacagatccggagtcaataataggaattatcgcatcacttggcggtgaaaagtttgaaatgacgaattggctcaagcccacctggtctcttgggatccaaacaacctctggctggtaagagagggacttgtgtagcattagtattcgatcttgagttggtggtttacgagtttccgctgtcttttcatctttatgtcgcctactgtctttctcactttcgtgttgaaagtaactacacaggtccaagggcagcatgtcataagtcctatcaaacttttggttgatcttgatgtggatataagttgtaactagcatagtgacacccatgtacatacccagggtaaacgaagaagatctcaggtaatgcccattctcatcgtggtctcctaccaggaagaaaaatcctaccagacaaatctctagacaataaacaccggcgtataactgacgcagtgccaccgtgtacagctttccaaatgtctcactttcgtttcggtaatccacaacatagagaagacagtgtttgtaactgaaaagaactacagaaaagatcaccgtgcagattatcaagatcagtggactcagaatactatatgccagtcctattgaacctatcagggagaaaaatgggtaaattgacccccaatgctgtttgggcagagttaccagaatcttgaaccgttgcctgggtgttcctgttctaaacttgaatatgatgactttgtgcagcaactgattcaattgaagaagcaagttgcctgagtatgccagtcctctgacgacaatgaaggaaaaaaagaagttcgaagcctttggaaggtctcttgcaaccaactttgggatggatatcggattctggagtaagttctggaaaacagaagtgatacctgatgaaatgctaacaactagaaacacctgtacaaagagaaacaaaaatagccatttttgtacctccagctctagctttgcccctgtcagtatcccctgatacctacaaaggtttctgaatgtctcataaacggcctctgttaacaaagacaatgcaatagttggtagcaagcctgagacgatattcttcatggttgctggtaatttatttatccacgccaacattgggatcaaagcggtcaaatatggcagatgtgagaccaaaccgacaaaggctacgggtacgacccatccaatgataatcagcagcattgcaaccttggtgaaatattttcggcatcgtttgatgaaactattttgaatttgaagattatcccatataatgtctttcgcatttagttccacgtaacattcatccatttcaaaatagttggagctcaatagcaactgtttggccatgtaggtcgaaagctgattgttcaaggtgatgaatacattatctgtggaggttatcccgtgtgtttgaagataagtcgggtcgtcgatatgtgacacgatttcaagtcttcgtttgttgatttgaaacttgattgcggtcattttttcaaggcaatattcaattgagtggactctttggatgtatttcatgccaatggggaatctgcattgcattttgcttccgaaaatctctattggtttattcatagtaaacatttctctttcaaaggttggatcaggattattcagctgcttccgcatctttcgtagtatctgtttctccagtacgccacgataaaatttgtagtcttggaccaaaccatccaatttgtcatggttgtaggtgaaccaaatatcagaaacacctcctgggagtatgctgaatatatcacgaagacgctctttgtttctatttttcaagctgacattggttagaatgatggtctttaggggattagagttttcgggataataagttgcaaggcttagcaatttctgacgtttcaattgtacgcagtgatacagctcatggatcaggatcaagtggaaccatactatcgtaatgttggccatcagacaatgccagaagtacctggcacttttctccatagagacattggaaattgatactttgtccagtcctgtagattgtagctccttgacgtttccagtgaagttgatcgggactagtatcggtatacatgttaggcttagacctccaaaaagaactatcaatatagtcagaaatctcagaaacaggtaagcgtccaaccccaagtcgttataggagacaaggggtgtacggaacactgtagagcaccatccaacgaatgagttacgtggaggtgggactttacaacggtcctctacgaagtatgatcttggttggtaaatgtaccggaatttttttcttaggtaagaaaatgcaagtacctgtatgagaaaaatggctagagcaaacgatatcgatgaaaagaaggcctgagatgagataccagaagattgatgagccttcccagattgtgaggtgttcagaaagtcgaatacccttgaagaagtgttcattttggaaagttctttcgtttggttggaggtttgagtttgtggaagctggaaggatttctgggggagaactactcactccagtggagccctgagcgaatcacctagaaagggccttaaagagccaaaaaacgaatagtttcctccgctcctcagaattattacttttgtacgttgttgacaacccttatatcttaagaccactgtctattccttttctatgtacattaatggagttctccagaagcggaagccttttggattctagcaatgtagtgacgagagatgacgttccaagcagacatgtactttccaatgcactgattcacacatgtttcttctgaagaagaataactgttggtgggcttggtaatgcactgttggaaacagttttcagtaagcttgttaaccagttcagtggcctgggccatggctagctcttgggagatctgctgctgaatttgattcttcaactgtgtggattggggggagctcatggaagaggtagatgttgaaagtggagtggtagaattatttgaacctccaaatagggatccgaaacttgacatgagagctggttactaggtggttggttggactttgcactgtcagatagagtgaaaaattagtggtgtttgggagtaaaaaaaaattaacttgagtgatgcactatgggagttggggtaaattgtttcagttatagaagtgtagagagtcagcgggcattgaagcttggggagagcagcagaataatgatttggtattagcagaaatgctcatcagctgtccctgtcaacgtaaacagcgactgaaacattaacaaagtttcgattgcttccatccgacatcttcctgtttagagagtgatacaacagatcatctgagagttgtggcaaaccgactcctagttaaataaaaattaacctctagtagtggccaacgtttatccgacctcccacccagtctgaatcatttgcaatcagcttccagatgacagcaataactgtaaaactgttatccaaattaagatctcaaacaaccacccctgttgtccggatatcgaggaaatttcggtatcaaatcaaccatcagatctcaaatcagccttaaaaaaccaaaaagttcaagtatctccccacccaagttcaatgtcagttgccgcatcaaggaccaaaagcaacaccagcagctccgtgaaaggttttgcagtggaccaatcgcccaagttgcatagaacagcttcccattcctctacgataagtaacagtaccctgcatacgaacttccagaataattggttccccaacagcgagattgtgccccaaaaacaatacgccgtgactttgaagttgtccagtagagagatagaaatggtccagaactcttgggctgatattttgtctatggatgttacaaactcaggtgttaatggtgagaatcttgccacttcgaacgcaaaatcctcaaaaagcagatcaactacgaaaatcctcaacgtcaacacagccagcttcgcatcatcaacgttctgcgtccaattctacaacaatttaatcaccatgatccctggagtggagaaacttttccccagcatcaagcatcaggccatatcatttgctggggtaatgaactcggcggttgtcaacctgggggacctggcagccatgcatgactatctggagaacttgggacggcggcatgccagaatcttgggtattgatcctccttacttcaaaaaaatgggagaggctttagtcaagacgtttagagacagatactctaaggacatgtcacagttctctgttgaattagaagagctatggattcgtttgtactgtttcctggcaaactctattttgcaaggaggaatcgatcctatagtgagatatgagccccccaacatgatcgactctggaagaaaatcattgctctctgacacggattctgttttattcgaagaaaatgcctccacgacaagctctctagccgatactaccaacgtcactcctactgcttcagctgcaagctcgtttttctcgggccgtcagtctctagcgtccacaatggatgtggtctccaccactggcggtgttccctctcctaatcgtgccagaatggggtctaccaccaacatggacttgaaaaagaaagctgttacgagcagcaccggccgtaacttctccaaacgttcgcaattctccaggatgaaaaagggaggatccaagccatccaaccctgacgaacccaactgtgtgcttatgtaattctagcctggtagtagttgcacactaaatatttttattaaaaagtcttttcgccttgcatgtaggaggaggcagttggtacctgtcgttcgcggaagcgcgtaaaacggtatttgacgtgtttggtgtttttcctattcgggcaacctgtatttttgccctgtctcaataaaaatctcttaaacagaaacagaaaaagaattgtcagaaggaggaaacacacccacggaacccacctttcattctttcattcacttcacgcacccgctgccgcccatcgaaagtgaagttgaaagtccccaattgagtcctttagtcaaatgtatctagttaacactgtcacttccaccccggttcatagaaagacaggatcttgttcaaaggattccatagtgacaatgagtacgcaggacgaggaattcttcaagtacgatgatcaccaggattccttccagaccagcgtagagtcttcgcctggcctgctagctagaaaggaggatttcttcaatatgggattttataagggcccctcagttgtgtctcagagccaaaaccaagataagaaccacgttgctgatttgaggcgctctttgattctttcttcatcagtaaacagcttctcctcgttgaaaaactcagagtcgttcaagaatttagccgtcacggacaccaaggaaactctgactcaaaagttcaccatctccactagtcccagtatcaaagccttagaggagattgtcaacaaaaagaccagtgccaagagcgatatcggtaagtccaataggataagtgtcatttctgaagagattttagacgatgattttgacacgcccatccattccatggaaaccctaacacaactcacacacgacgagcccgtcgagaagattgatgtcgtagatgatgccgaagacaacttggttgatctgatcgacttgaatagcgaggctgatgcctcagaagtcggtgccgctgttggtgttgctgttatccccgctttgaccgctcctcaagaaataagctatttagaccaaagtccagttgttgtccaagaggaggaccccaaagacaatgccgatttgacaccaccaccatctatttccaatgctgccgcatctgaatcatcttccaagtcccagattcgttctgttagcgcttctgtttctgatgtagatagcacgtcttttgtttctatgctagaggaggctgaacagtatgcgcaaacattcggggaacttcctacaataaaggttgttcagaaaacaactgcaccagataatactccagcaagtcaaccacaacagaaatccttatcttcagtgacattgctaggactttctgagcagcccaccgagaaggttcttccgactccaaaccccatcgccaagtcaaagtctgtgactgatcttacttctacaaagaagaagagaatgagcttcaaacaattgtttaaatcgaaaaagtcagagattaaagagccaactaaagacaagaaaaagaagagtgtcttttcactaacaaaaaaacaatccaaggaaaaaggtaagaatgcgtcaaagacgacaatctcgcagccggtttctgcaaccaagaaagatgtcttaccttcaaatataccttcagaatccaccattagaacgacaagatccgcttcaatggctgatgtctgtcgccttgaatcaccgaacaattacaggttccataacgcctcagtacatgatatagcaagcgctactgctacacctgacactatcaacattgaaaacttcgatctccactcatgcacttcctctccccgccttcactactcaccaaagaacacccgatctatcttgtctgaagaacatagcatagaatcagggcttggtattaatatcgaaacgtttgaagattcatttaacttgggagagccagaaacttccaattatttgcatggtggagagtctattttccctaaatctctagaccctaaagagatcgaaagcatcaaatctttggagaggtcgagatcccagagatcgctgaaagtgggtagtataatgtcaaaacaaagcatccaaaacgaagaagagttagcagaatttgctgatttcatcgattttggaggagacattccaatcgatttcgatttcgatatcaactccttgaatagtggagagatttttggcagcgatgtgatcgatgaaaacgaccttctgcatcaagacagccaaccagagctattgcaagatgaaaatcatgatcttgtggaagattctgttgaaaagctgtctatttccaaatcaagatctcccaaatcgccagtctttggtggatttattccagacaacctggatgataacgacaatagaccaatttcaatgtctttccgtggactaagaggaccaacttgcaaagagtcatcctccaagtatctaattccttccaaccaatcgcacacttcactactaatgacagactcggtagaagctgtttacaaacaacaatgcaatgtcagatttaattccagaatcattctatacgacacatacaccggactagagtatgatagacatccagagacagctacttgcaataggttaactcctatgctcgcccaacaaattaaagaagaactgaacacattgaaggcagagatggagatccacgaagaatcacgttgttatacgcactttttttaactttggaactcttttatttactactaatacaattatttctctccgtaggtttgatgagcatctgtgaacactttttgaagtagtggagtcgcaatatcttcaaatctggctacaacttcgtctggtttctgaatgttcacagcaacaaagtatttgccggactcagactctttaacatcgacagcggtttccttagcccaccctgcactgtcatattggaacagtgagatgactggtggtttaccatcaacgtaatcggggaacttgacagacatgtgtgggagcaagaatcctgcggtgagaaaaaaaatatgtgcccccctgctgggtgggcgattcagttttccgcccagatagtcccaacatgtcgcgagcactgaaaactttcatttcctaagtatccaccatcacccaaatgacaatcgaaatacccaagttggctgtccctggaatggtcttggctcctgagtattcgggcaagataccttccattgaagacttgaatgaacctgaaacaggtaaagattgcagatgccacttttttgctggtcctggcaccagattggataatttagaactaggcaaagagaactccacatcacagatcccaaccataacggcaaccgtactgggacaagtctgtgtttttttgaggagtgatgaagagaatgtagaggcaaagaagtcagaaaatcgtgaatacgtggtgattgtagtccccttcaagaataacaagattgaatacgaagactctcaagttcctcatataagtaaaaaagatgaagcttacctgaagggaagtagtcttcctcaagaaggtgacattgttctagtaagagtcacaagaatatctcaaaggcaagcaaatgttgaagtgttagccgtggaaggaagaggtaatgttggtgaagaatcaggagtgggttcgaacggatctggagccattgcttctggtggaggatctggagcttcctcttttatcaatgctatagcgacctctgcatcgctgattgctcaaaggtccgacattggagaaaccttcaaaggaattataaggtcacaagacgttcagtccactaatagagataaagtccagataaataaatgctttcgtccaggagatgtgttgagagcaatcgtaatctccctaggtgatggttccaattactacatgtccacagcaagaaacgaccttggggttatcctggctaaatccaacggcggtgcaggtaatgccatgtacgctgttgattggcaaacgatgatagatcctactacaggggttatagaagagaggaagtgtgccaaacccttctcataaaatgcattatatcacattattcatattaaatctatcatattttttgtttttttgctgctcttaattttcttctgtatctttctcctactaaaatgatgctctgaggtcaatttcactcaggccgatggtagcaccgagttcttcgaaacgctgcatgtagtgctctttcttctctcttgcaatttttagcatttcgggccaatatttggcatggtcatagacaaaattgacatctccttcgaattcacggtctagttgttcttttgggcagtactggatgaatggctcgtcaaagacaagtttctccctggttaatggatcgatgaatggatggattacttttaggaacgtccatcccaaccatggaatattggtcaataaagccttcccaagacgttcgggataatgggtttgtaaaatatgtaagacttgacggcctacaccaattggtgggatcttggaagttgaaacattggctgctacttcgggatgctgcttgaaatcgatcaataacgccaaggaatcttggcctgaaggcatgtagtcaatgactctctccaacatgaataccaagtgctgaacctgtctatgtgatgttttggtgttctgacgacctggtttcaagtaaagacatggcctagcatcattttcaaatcccaggatcacttccttgcctgtttcattctcaggagataccagttctgcggtgacagtgttcaaagagtcgtccaattgagcagagattccaaactcccttctccatgcaatagtgccctcaatgcgatcaatgcagtctttataatgccatttagtagccctcaagtatcgtaagatggcctcgcgcgtcaaccaggccttctcatcatagctcagtggctgatgatctgacgaagacgagtttttctccgtcacggggatcctaagatcttcgttgctgaagtactccagaacctggtcatacagcttctgctgttcggcggtcagttcagcttcctttgggggtttcacggaatcaagtgggtcggtaaaaggtagataaacttccgggccgaggtcttcagagggaaccttgggggcagatttcgacgaggatttctttccaaagcccaacattaaagctcttgaacgtctgagtacctaattggctcttagatgaagagtgtaaaagggtgggaaaaaagtggcgagttatgcagcaggagaagaaaaggaaggaccccatcgattcgtttatttcatttatgctgataaatccaacgttaatttcataattcgcggttaatactggaacgtatttcggaacggaagctgtcaaagaaaatacttccgtgaatagggggtactgaggtagaaaggagggggtttctcctttaataagagtgctagtcgatgctttcccagtattctgtaatcgtgaagtttagttgtagtttcaggtgtctgcatagcctgtctaggtcttctgtcgtgtcgtgtggcctctcttttactgattgctcgacatctgtcatcctcgcaattgtgccagacatccaacatccaagtaatctatcaagaaatatactaccttaccaagcatctctccaaagaacatccagtaacttacccccaactacccttaaactttcgaaaagccgatgaaagagaaactgagaggagctcgctcactgtatgagcttgcctctgccaaatgtataagatccatcaagttgatcaaagatgttggggaagtgcctgttcatgtagtagagccaatcctggccaaaatgggtgcacatcaactggaagctattgaaaaaatgtgtccccatttggcgcttagtacagacaagatatggcagaacctgatagaaaaagatttctccaacagacctctgaatgatgggaggctgagacgaacaaagccaaaagatctttacatgaaatatagacaggaaatggaggacttgaggaaggatgcaacagagcgattgaagaaaacaacacagagattaaatagaaagaaacaagagtcaagaattgtccagatagatcagttgattgatccatcggcgaggaggaaacgaccagagcaattccaggcacacaagacgccaataatgcaaaaagctagacaggaagctctattgaaaagcaaaatgttcaaggaaggcattcgtttcaaccaagcaccaaagacagaaaaaatgagggtccccggaggattcaagatggctctgcagaaaggtgagaaatatgaacctatcaccagaggagtgaaaggtacggtgtctatagcagtaaaagatggcaaatcgttgaaaggtaatgcaaagtcatccgaagaaattacgcagtcttcgaagaggaccacgccacttcaatcaaagacgccttcgaagagacatcacagctcaagatctcccaagaacaacgtattcatatacaattcatgacatttctaaatatacataatggcattagctcgatagctttttcttttgacgttgtaatacagtattatcttctagttttcttttgaaatgtgatacagagttccctctctcggaagcactgccaaccccaccagctaaaggctcgtcccctatggcagctgtttgtttatagctcctaattcgaagagttccatttaataatactttggcgggggatgatgatacgcattgttttgaagtggaactggcaaggcctaacaccgtcaacaggttaattacatcatatgagttccggcataataggggattggtagcaccactggagataaccaatccccttgaacgagatgctctaattaaagaagctacaccattgaagaaatgcttcctgctaatgcctgcatctgttattccattatccgttgaaatgctaccagctggtccatctacagctgcacagtagactatctcaaacagaatgcctttttctatagctgaacatacagttttgtgtttcaaatagcacggcagtctttctccgtaattaaacgtaattagatcgcattccaagcttgatactgctagttgcagggctctttcacttctgggtctaacagcaatgatatcaaaggctcgggtcaacttgctcagcccttgacactgggatggatcatctatgactagtgttattctggtgtataacttgattcttcctttgaactctttgaataatgaaaggtctattggattgggagttttagtgtcattaggaaccttgtttggaggaatcagctcaaaattgaatgccacctgtgaatagcccagttcttctagtgtgcaaagaatctgtttgagagaatgcacttgcaacatagtgggcctctggttgtaggacgcaaccggccatgggatgttcaagtcacagagcattgaagaacagaaaatttgagattgatagcgagatatattgtgctgggtggagagctctagaaggacatttggacggagaagtacgcgaagtaaaaggaatataataaatcagttccaaagttctgccagaacttaatgggctaagaatgtgactcaaagtagccacaacggacgcaacgttcttaaaagtggcccttgtctccatatcagcttatccatttttgttcccgaatattccattcacttttttgagtattgccactggacatgtactttttgcctcccaagatttctatataaacccgagatcccatttcgatcgctaatctccaaccttcctgcaaccttcaattctctgatcttccccaaagtgtcacagaatatcggccaatccctaatgacggactttgacaaaggaactactttgatggaaattggtgagcattgccaaatatgcaaccaaattgattttcttcccttcaaatgcccctataattgtgggttagtttactgtgagcaacacagatcccacttgaatgaacacaactgtccaaagaaaccccagaaatctaatcagtccagactacaagagcatagacaagtccaatcatcgaagagcttgttcccagaaaggccgaaaggttacattctagaacccccatcacagaagcttacaccctcatcacagtcctcctccaaaagcacatcatcgttatccgaccctgcaaaacaggcgttggcaagattgaagaaatttatttcgtcttcacgggccactaccaagaaatccagcgttttcagtttgaaacccaaaaagaaatcgtccacttcgtcaagcccgtctgcatctcaaaaaattattcagttggccaagttgaaagcagaggctaagggagaccccaaaatctccctttcggaaagagttcattactatgtacaatacgtctcagaagacaacctccccagcgagaacaaccagaaatgctactacgtttccagaagttggcccgttggtagattactagactatacggccaaagaaatgaagatcaaaaacgaaaataacaagactacagacgaactcaaaaggctgaccattttcagggaccccagatcaggggagcaaagttcagacgattttatatttgttcccgctaatggtagagtgagtcaagagataaaagacgcagaccatttgtatttagtgcgtggaactgcattgtaaatacctaatttctaaaatgatatttaacttaacttttttataactcacctctaattcatgaacaacacagtattttcgaccaaaatccacgcttggactttctggaatctgcatcctcctgttgattgtacgattgttttattctaggatccctggttggagaattagtgtttgcaacgttggtttgcgaagtttgtgaatgtaatagctgagcttgggaaatcgctggctgttgatactgctggttccgacgctgttgttgctgttgcgatgctgaattgttttgcggaggtcgctgctggttattaggaagcgttgggagcggcctgttgtaattaccggatagcacgccacctcctgaagtagcagcctgttgttgttgtctagacttgcgttgctggctatgacgatgatgcctatcacgctctcctggagggtttggatgaccatatccgtgtaaattaggctttttgttgatggaggcatcccaacctcttcccccattcaatttcatccagtcgtattggccatccacggtttcattaatgtcatccaatgcagataacaaaagtcttctgtagccttcgtaatctggatcgctatcgaaaccgaggtttcgtacggtttccagatattgggcaaattggcgagggagaccggaacacaaatcataaacaggggttgtacgtttcttctcaccaattttctcgtacttttgtttgttcgtaggtgccttcaatccttgccatggcagttggcctctcaggaagtaaaaaaagacgtgaccaagggcctctaagtcatctcttctcgattgttctctacccaaatgggtattgacggacatgtaacgggcagtaccactgagagattttttctctctataaggaatgtgctgcttagtccttggatctctatattgtttggccataccaaagtcaatgagatgaactttgttctcgtcaggtaaccctggcctaccaatcaaaaagttatcaggcttgatatctctgtagataaggtcatgactgtggactgtttcgataagggtgagcatctgcacggctacaaatacgacacttttcacagagaacctgcggccacaccactcaaagaggtcctccagagagggacccaataagtcgatgaccaaaatgttatgcagaccttcttggccaaaatagtaggccttggggatgccttcgcaacccgccagatgcttgtaggttctgtactcatctctcagttgaggagcctcagtcttgcgaggttcaaactttatggctactggaagggagttgagcatattggttccttcgaaaagtacaccgaacgagccttctccgatcttcttgccgattttgtagtgcatgcccacgacttgactagaagttgattgagaactgttcaatagctgctgatgctgctgctgttgctgctgctgttggatctgagcatttgcctggaccggagactggacttggcccggagtcccctgggctggcgcctggacttgaggacttggactcgctgcaatagcagcagcctgggctggacttgctgatacgattggttgtctggatgacatttctaacaggtcataaaactatataaaaaacccgaaagaagtaatgaacaaaatagtgaaacgtggtgacaactgtgaattttgctagagccgaagaagctattcacccaacttgatgttattagttcacctttccagaggaaaaactaatggaaatgttaggagggtcggaggattctgtggaggactaagtgtttccagttttttgttgtttttttgggtggctttgggaggtgaattcgttggacggaggtacacaagtgggaaatagaaagcaatgcgaggaagtaattggccaagatgcacataaagtagatcgcggaattgggaaatctcatactccacaaagtgaaaaattacccggattgaatgccgtcggccaagaccaagatgaaggtggtagctggagggggcggggaggggggcatagcgtggtttgagggaggaagaaagtgctgtggaagtcttcgagacgtgcatcctcagggtgtctacggttgggacgtctgcttgaccagggaccattacacgagatcgggcggggagggctttatcggttcagaaaatgatgcatacagaatatctgaaagatctcaggtggttgctgagcctagttagcgggacgatcagggcacccttcaaagtggaaatagctgcctctgcaaatgcgtggaatattcatgaagcgggtttcccggctgtgaaatatcccgctccagttcgcagaaccaaaatgctattgttgaactactgtgacttggctctgatgattttttccggtaacggtcgtccaaaaggtaccccagtaatcatccgaaactgtattctcgatattctttttaggcgacattctctttaggctgactttctcaggaacagccactgtggtccccagagaatcttgaatgtgcccgcccgtggacctctcggtcggcctagctcagcccgtcaagtctccttctatctccatcaagtaatcacccacgtgcataattttatttgcagtttcacacatccgtcctattattctgatcatcacctaggaaaaagaaaagcttaaatcttcaacggtttcttgaactacttccagatggtcatccaaaaagaatttgatctcacagtgggactgtcggaagacaaggaggctgttgtatcgtactcagaccttaccccggagtattccaccatcagtttgaacctggtgattgacaggagacgtaacttgcaagcactattgaataagaagcttctgtggtcagctccatgctgggtgggggtcctctccatctctttaggctatgggtacttcaagttggctgactatttcaaatacatccccctccaagaattgatactcaacaataatttcagatatgaactgataagcacattgattcttgctggaatggtcttttcgatattctttgcattgtttgctttgaagacagagtttctacgtgctgatgctgacaagttggtcgaagagtcggagaaagcctttggattcgaccttaaggcttacagcaacttaccagtcaacaccgtcgatgagtacaaatcattgagaaagacagatgacaaagagctggaactgcttgaaaatggaaaaaattcacagatagttatttacagagaaaccccaattgctgtaatctccttggtggtcgataaagatcctaaccagacgaacaattcgtcgtatgtcgttcgtatccagagctttgggatccgcagggtttatgtaaaatcgggaataatgaaagaactcctgatttgggctctttacagaactcgaactattgtggaggccctgaatgcttctgaagtgctggttttgtgtgaattatactcttttgaaaaagatgtcattcccacatttcaagaattgacattcaagaagatcagttctcgtccactgaaagattggttgttgggaggtatttacggtgttacccaggacacatgggcaatcggattattggccgatgggcaagatggttcttcgaaggaggctgtatctagtgactccaagtctacagatccaagcggtttaagaaagagaaattgattacaggtaaggttagtttacaatgaaatcgggtgtcggtttactatggtatatttgctcagcttggtgttgagcaatatggaatttattggatatttttattttgttcgtaagacctccagttgatttgatggtggccggacttgataatccagaagatcgttatctttggtattcgttccatcgtggtaagtgtgtacgagctcatatcgttttttctggaggagtttcaagctgagaactggaagtctaagtcaacactttctcggtcaatcctccattcttgtatatagatgacgccctatttatataaggaataaaatacaattacagggcatcttggtctgtcagattcagtgtactaattgggacacctacgaatcaaatgaggagctgagttttctatttgttcctactgaaataagtataagcgttgaagttaatgcgcagacgagtcctcaactactggcacgagcaagaagccgaaccatttatgatccttaaacggagtaacttcgaaccataatggtttatcaacccaaaattgatctgaaagtcttatcctcttagagagactcctaaggaacgcttcagaaaagtatttcagttaactcaaactatttgtgtatgaaaacgaaccgcagtgcaaacccagaaacaactacaactctacaacagttataagtcaaacaatatcattacacattaaaagtttaaactctctctacgtgagtaatggtcgcagacttgcgatcggagtcgttgtctaacttcgtagtcaaattttctcctctcagaattctctccttttcggccaagacaaactcttctggtctctctctttgagtcagagccttgtgtctgaacacaactggcgatggatactggataaacatgtaatccaaatcctccaaagaacgcctggatgtctctggatagagacagaacactactggcacgtagcacaggacaataaatgcaaacagcaagtaaaatccccaacccaggttgttgacagctttcttagtgtattgagtgatacagaaaccacaaatccagtttgtggcggtagcagctgctgcacctctggttctccatccaatagagttaatttcagaagagtacacccaaggcactttggcataagatgttccataaatgacataatacaggaaaaacatcgaaaccgtcaatgcacccatctcataagccagtctagtctcggcaaccttgacagaagcagcagcaacgatataagtgatacaacatccaacggatccgtagatcatcattctccttctaccaaccaagtcgataatgatcaaacacacgaaggcagatcccagataagaagtagcgttgcaggcggataataacttggccatagcttcggtgaaaccaagctgctcagtcaagatagttggtaagtagtaaccgagggcattgacaccagtgaactgttgcatgaattgagtacccattcccaagagaatacgacgcatgttctgagtcttgtctctgaatctgataacgtctttgaatggaactctgtcaagtctttcttgctcaatagcatccaaaatggacaggtactcgtcctgaactgtttcattagtaacttccagattctttccccacagcaaggcgatagtggaaagcccctcctgagtgcgtcctttattcaacaaccaacgaggtgattcaggcaagaagcacagaattggaactgaaataattgggaacaaaagttggaaggctaggggaaatcgccactgcaaaggacctgaagaaaaatagaggccatagttcatccagtttgccaacatgtaggcaaaagtattggaaagagatcccacgaccaccaaacgtccacggtacttggccttggtacattcggcctggtagacaggacatgtggatgatgtcatacccataccaaacccgtttattatacgtccaataatcatcatgggcaagtgaaaagcagcgatttgcagtacagcaccgatggtgttgcaagcacttccaaccataatagttcttcgtcttcctagtttatctccaaaagcgaaagctaccagacacccaatgaaggcaccaagagaaaaacaacttgaagtaataccagaaatgttagcgtcgagcgtctctggaaaatgatatttaaagtcagacgagataagaacgcctgaaaagacaccttggtcgtaaccaaaccagcccatagttaaaccattcaccaaggtgaggcaagccaacagggcattacctgatagtccgaaatgcttcttgtagagtcccattaagcagagatcgttattagtgaagtagttcgtgatgagattatgacgggggtatttataggagctgttgatattcctttactccacatttctaaatggacctttattattaaagtgatgcactacagtgaccagttttgttaaacggtgtcgttacccaccttataatgcgcggaggtactagcttcgcagcacggggtgcatgatcgaatataccggaatcgcataacgtggacaagattacgtgggattttcattaactacgacgagaataactggtgtttaacgagtagaaaacgcagggtagtttgatggattgtttgaaatacctactccgcattgaatagcaagcggactgaaggatgatcgagtcaggggtggtccttgatcgttgagtgggagctgtatgtaattcaagctggttttggtcttggtaaagttaatgtaagcgtaaaccatctaagaaaaggggtaaaagtgggaaagagatttttggtcacatatctggttgtattctagaggagaataattaccgttcaatggcatgttagtgtttttctccactcaatatccagtgccttgatttaactaaaacactgaatgatcacctccaacttgaactgttccacttagcgcattgtcagctgtctgaaaatgaacagcaagtggagataccgccttaaaatacttctcattaactctcagatactaaatagtcatttatgcttactttcaaatatatgcctctctacctataaagggccctgttgaatagcccgaaactgtctgatagagtccacaacacattgctcaaaactatgaaactccactccaagctccttggtaactgcctcatggtccaggttgtaccctattggattcagatcctgtttagaaataagtttatcaggaatgcgatctccaaggccatggtccttcataatcttcgcagcaagtgcataggagaacttgtctggagctgatggaacgtatcttttatttccagctgatggtctcactaaagcctgaacatgagccttagctaaatctctgacgtcaacccacacggaaactctagcaacaggtaaaggatctacccctgagtagacctgccagagcatgtcattcgagaggttgagctcctccactttgtccactggatgaactacaggaccaaaagtcatgggaggacaaaaggtcaccaagtcaaactgaggtttctccttttcaatgaagttccaagcctccagttcggcatatttcttcgatccacggtaaccgataatagcatctgcctcacaagcttcttcataagtaagtgggttccaatcggctccggtataggtgaagcctggtccagaacctctagagacatccataacggatgcaaaagaggatgtcaatactatccgtttaacccttggttctgtaacagcagcctccaacacaaccctaacaccgtggatggcaggtttaatcagctcctcctccacatcctttacatcatagctcaaaggactggcagcgtggataattccgtcacaccccttaactgcattgatgaaggggttttcggtgcttttgcttgtaaaatccgtaatctgaacaggttcaatcagagatgagaactgcggtcttttcttggcaaactgttgagctttctcaatatttctagtggccaatttgaccttaattccgagtttcaaaaggttatcaactatgtgagccccaatgaacccggttccgccggtgaccaatacttgccttcaaagttagttactttctatggatcgttaaggaagtatggtttcttggcaagacgagggaaagaaagcttaaagggaccatcctagtcgttccacccacagtgtctgttcgcccatgattgccaaaattcaatgatactcacttcatatccatctttcaaactatgggatagtgattcaagagttggaagattaaagttggaatatttatttaaaggcatttctggtcatgtcccccacatttcatactgcatccacagtggataataccgtggaagttcacataacggggtttgttgtttttcgtaacggtgaaaagaaaaacggtgctaatcccatgcaatcccacctaaaacatgcttgtacacctaactttaccccagaaaaaaaaagcatgatcctccttcgcgtgctgcccactctattccaaacgcatgaaatttgtaccccaagctaaaacacctgcctgtgtgcaagctcttaaccgtgatacggggtcctctatataaaaactccacaagtccagagagttaattaaattgcttctctgaccacaaaaaaccatgtctttgaaaaacatcagaattacaggctttaaggtaaccgacatcagattccctaccagtttagacggaattggaagtgatgctatgcatcaaggtactaatggatctcaccccttcttggagttgtacaccaacgatgataaggtaatcggtgaaggtattgctttcagtaatggaagaggaagtgaattggtgtgtgctgctctggagatctttgctgaaagggttgttggaaagtctctgcacagtctgaccgaaaatatggggaacacatggagatatatggtttctgattctcaatatcgttggattggtcctgagaaaggagttactcatcttgccgttgctggtgtcatcaatgccatttgggacttgtggggtaaggtaactgatagaccagtctggaagattgttgcagacatgacccctgaagaattagtcagatgcatcgactttagatacatcactgatgtcattacccctgaagaggctattgaaatgttgaaaaagactcaagttgggaaagagaagagaattcaagaggcatttgataacgttgccgttcctgcctataccacttctccaggttggttagccttttctggagacaggatgaaagaggttctgcgagaaaccattgcacagggtttcactgtctttaagttcaaagttggtagtgatctcaagtccgataaggagaggttgcaagcagtgagagatattatcggctatgacgaaaaataccaaattatgattgatgccaatcagatctggagtgttcctgaagccattgagtggatgaaagagttggttcaattcaagcccattttcattgaggagccaacttctccagatgatgttctaggacatgctaccattcgtaaagccctgaagccttacggagtcggtgttgctactggagaaatggcagccaacagagttatattcaaacagttgctccaggcagatgctattgacgtttgtcaaattgatgcggtgcgtcttgggggtgtcaacgagtgtttagctgttatgttgatggcactcaagttcaatgttccctgcgttcctcacaatggggcaatgggactgacggagttgacatcacacttgagcaacattgactacatttgtgtcagtggtaaaaagagtatgttggaggctgcagagagctacagagaaaacctaagacacccatctgtgatcaagaatgcccactacgtgactcccttagcaccagggtactctaccggttacgtcccaggtgctattgaaaagtatgtctatcctaatggaacattctggacctctgaaattggtgaaaagatcaagcgtgctcccaagggaggagaagggttgttgagtgatgattaagtagtttcatgatatatagtaaatgaccttttcatgagaataaagtaatgtatcttcaaatgcaaatttaccactttgtaagtcaagtatcaaatacaccggatcaatgcagagtggtaacgatcagcagatgtaatttgtcctcccggaaacactcttgccattatcgctgcaaggatcaaaaattcaattcttctttcctccaggttaagcattcaactctactgtttttgaagcacatgaagtacatacagagaaattgagagtttcaatttcccattcatgttttactagcaagtagatgactttgaagcctgcgtatctggcctaaacattctacatgcactatatgtaatttggcaaagaaggtctatcggttgcggccatatctagcagaaagcaccgtttcccgtccgatcaaccgtagttaagctgctaagagcctgaccgagtagtgtagtgggagaccatacgcgaaactcaggtgctgcaatctcttttttcttcctggtatcttcagtctttagtctttgaagctggcttgattaggagtggaaacgtagtcaagaggcaagaacgctcttcccttcatacaggcagtgtgagatcccactttgtgatcttttttccctctaaagatttccttatctccaaccaatccacgcttatgtaatatctacatagtctgatctgaggccatcggagccttaaaagtcgtcttctcaaaaccaaatatgaaacagttgatcctagctagccactaaagatattcttttacccttttcccaaaaagaacacacttaagtgaatagaactcgggcgaactttcaccatcctaaccgcatttgtgaaggacgagactagtccttctataataacccaacagttgagcccactcattgaaacgtcttcatgaataacttgcgcccagattttgatgcacttgttatagactcgtcttttacagacgactcgttggtttcaaagctccggatgatggacctctctgatatcgaacagttgaaagtgactaatggcgacctgacacagttcaagttgccccaggatatcgtctttccaaagctaacttcatgttatttcatatccaactccacgaggcccttctacgtgccacgccgtccagatatagtgacagacagagacagtgggaaactggccgagatcgatgttgatttggcaacatcgttccccttgatcgaagtgttgacaatcacccaatgtactaagttatccagggtcgagttatttcacggaaaagactcggaaaaattagccactctgaacgttagcaaaagctttgattcgttcaaagccttttcgcaattcttgaatcaggccctggatcactctcccaacttgaaagacttacacggctcttggttcacatttaaagatgcccacaaaaatgtgctagagatatcccttgacaaatgtccacagttagacgtaattttttttcaaaatatcggcgcattttcatcggttcttttgcactctacagcgactcaccaagtcaaacgtctttcattccaacagacaactggattgaaatcaattcaacttgacccaacgataacaattgaagattcgcttaccattggtgattatagaggtgagacaagactacaaacagatatctctgctttcactgcatgcaagagtattaccttatcaggtagaagttggaaagtcttcaatttcgaaaatgtgaagtttgaaaacttactacaattgagtatccttcgatcaagtcctattgtgaacacggagtctcaagtatatgtctatgacaaggaaggtgaatatggtaaagatgaagctctagaaatccaagatagtattattcgtacattgggccatgacgagaactttccaagccttaatttgcttacatccgagtttgttcaggatgttgatctttttgtcgatcttttgaacaaattaccaactctccttgtatcatttgacgtgtgggataaaactaacactaaacctttcgaactctgcaaacccaccaaactggaccgtctgaatatagagaatggtcagtatcctcttatcaaaatatcaaatcaagattcactggatgaaatcagtatcaactgcctccccaagtgtgcttctattgaaatatctaattgctcaactttgagtctagtagagatttacagtattgaagaaaagtgctcaatttcgtttaagaactgtcccgaattggccgagataagattggagaaagttgagcatatcgagagcctcgatatcgacgaaagctgcaagtatctggaagaattggtcattgagaatggtaagcctttcaatatgaaaattccgcggtcagttcttgacaatctccgtttagtctccttgggagagattgacgagctatcagcaagtttctctaacgcaacgacgattgacattttctcagagtcctctctgaaaactttagagctacaaaacactaaggaactgaaagaattatatgtcaagggatttccgactactttcacaatggcagatacaaccaaacttgaacatgtcactgcatctgaaggctccagcgtatatggtcatttcaagaacatattagcgcttaccgacactaagaacccattgaagaaccattctattattgatattgttagggacgatttgacggaagctggatgcttctatggtggtaaaatatatcaaaatggcgatgaaaaatactgtcaatttgaaggagacagaaattgtccgatttgcttggaggaattagccgaagaatgtattattctttcttgtggccatcctttacatgatgactgcttgaaggaactatcacgggattcaacttattgtcctctttgcaattccaagctgtggggccaatcttttgagttgaaagtattttgacagtttatgagatgtcttttcctgcgaatgaacagaaagaacgcagcaaccaggcattaatgcattccgtcagggtgtttacttctggatacggcaatgtcactattatatcgaactatttgtgaaaaccctaaattaatatcagatctttactactgcatgcgcacatgaatctcctgaatgcaatgcagatctatttcttagcgcacctatttgccctttcttggcttctttcttatcttgcccatacaaatgaacagttgatatcgactctcgcagaattagctctgcaatcaaccaaagtaattcaatgattccagggcacttgttcagccagctctttcatttagtttgcgaacacgttgactagttgataggagcgaacggagctcagtatttgcagcagcacagacatccctgagccagagaatggatccaacaggtatctgatgccaggctttcttgattcatcagcaacaaagaactcaactcaactacctttgtgtcaatttcgttttgatcagataagatctctggatgttctcttggatgataccctgcattaagggaagtctaatactgcatggtggtacaatctgataatgaatattattctcagttgacatatcagtgtacttagatcacgaccgaatatgaatctgtaggcatttcacaactagactcagatatatttcaagttttcagctgcgtacatgaaactcagatacaatgtgcttactcaatacctgcagattcagatctgagagtaagataatttttccgcgccgaaagagtcattccaccgcaccaaaactgtatatgtgattcccgtgttacggatcctctttcctgaaaataagtgtttcggggaattgaaccttggtgattacttaccatatgggcgtttataaacagtgaatatttcacccttcctttttacgatcaaacaatcgattcaccccttgaaaaatcatgagtacgaatgatttgcctcaaactgtttttggtgtacttgacatcgactcctcattcacggaggaatcgttgatttcaaagctacgaaagatggacctgtcagcggtcactcaactgaaagtgactaatagcgagctgaccaaattcaagttaccgcaagatattgtttttccaaagttaatttcgtttctattcatatctgagactgcggtgttctttgattcggaagaggtagattcagacacagaggcagaaatggttaaaggaaaaatgactgagattgacgtcgatttagatacatcattccccttgatcgaacatctgacgatcgccggatttcccattttgtccagggttgagttgtttcatggaaagaactcggagaaactaagaactgtgactgttagcaaaggctttgaatcgttcaaagccttttcacagttctcatgtcacatcctgggtcactctcccaatttgaaaagtttaatgtacttatggcttttattcgatgatggcaaaaatcatacattggaggtatccctcgacaaatgccctcagttagaggatatgttctgccagagcattgatgcgttttcgtcgattcatttacgttccgaaaaggagcaccgaatgcagcgtctagcattccaggagactgctggattgacaacaattagactggacccaacgatagtcatcgaagaggcaataactgttgttgattatagaaaagaggcaaggctacacgctgacaaatgcagtctctctgcctgcaagctgattaatttatccggaaggtgttggacagagcttggcatggaaaatgtaaagtttgagaacttgaaggctttcagtatccttcgatcaagtagtgtggtgaatcaacacttcaagggatatttactagaaggtgaatataccaaggatgaatcattagaagtgcaagatagtattcttcgcactttaagtcactctgaaaactttccctgtctagaagcatttatctgcgagtatgttcaagatattggtccttttattgatcagttgaatcagttgccaaatattttctcgtttgaagtcatagacaaaacttcggttcagcctattgaacttgacagaccatgcaaactacaaaatttacgaattgatactggtcaatattctcacatcaagatatcaaatcaaaattcgctggacgatgttagtatctgctctctccccaaatgttcttctattgaaatatctgattgctcaaatttgaccagggtcgatgcttacgatttcgaagggaagtgctcattttcgtttaaaaactgtcctgaattaaccggattgaggttggagcatgttgagtccattgagagcctcgatattgacgaaagctgcaagaagctaacagaattaaccattgggaacaataagccattcgatataaaactacctgagtctcttcttgacaatcttcatacgatatcgttgggagagattgatgagctatcggcaagtttctctaatgcaaatgtgatttacatttcctcagagtcatccctgaaaagcctggaactacgaaatactgaaaatctgactcatctatatgttaagggatttccaaccaaatttacaattggagagacacccaaattgaggtacgttaatgcctcagacggctcccaagtatacactcatttccagaaaatgctagcacatttagacacaaagaatccattgaagagctattccattattgatattatcactgatgagttctcaaaacttggagacttttttggtggaaaagtataccaaaacgatgaaacaaaatactgtcattttgagggagacagaaactgtccaatttgcttggaggaattagccgaagaatgtattattctttcttgtggccatcctttacatgatgactgcttgaaggaactatcgaaggattcaaacgattgtcctctctgcaataccaagctgcgagaggagctgtttgaattaagagcatttgagagtttttagtcgagttgttttatttttgtgggacgaccatgcattgaaccaatagtgctcagcatgcgagtgtataattctaagtatcatgatggcactatcgtatcatacatggaaaactcttatgtaccaagtagtaaaaggtaaaagagatctcttccatacgtatgcagatttcaatctgctgcatgcaatgcggatttaacttagaggctgcatctaatcgatatctttgtgtcctttcttttagctctttctttcttctccacaaactggcatgtgataccgaacaaacttcactcgcaatctcatctaagagctccacaatcgccaagcattcgttaagccatccatctcagttaggcccacttcgacccgtccacccaccggttactagtaactaacagacactattcaataggccagcacagaaatgaaatctatcgctttctgttccaagtcacctgtcaacctgtgattatccagggtgcttggtcgaattgcacttacagcataattacgttgtaaacgacattttcctgggagataactacaaaaaaatcccactggtattgtaaccaccatgaaactgccattgaataccagattaggcaatctcaactttcaaagcgttttggagtccaagattcagttcaggaggaattgatcactcagatggtgttggtacccttgacgttaccctgtgatgtcacaatgctcaagcccctgctaaactctctttagtgggtggttttgtaaattttatggttcattcaagtggaattactatgtgtagggcttacgaactcaggtaaagggttcctttattacttacataggttatgtaggtgtcagaaaaaggggagcagaccggacagtacactgtcctgcggaaatcgaaactgccatacctccccctccccctacttatcctatttagccttcctacaatcgtcggaaggttctacaattgagcagctgctatgcagcgtccaatatcccctacgtccatgctacaaaaaaaagtccccgaaggaaacttcaacgccatcctgagcttcagacaaacgaaaaccctcagctcaataaagagaatcgacattctcgggattcatggacacttggggctgaatgatccctgaattgttctcaacaagtggtcttcaaccttccttagaatatcagcttgaatttacgttgactttcaaattgcccaacttaacctgggtttagaaacacaattcctcatacaagttaagagaagctcaaaagagttcttcaatcaacggagagagttcccgctagaactgaaatcccctcgtatcccaaacgataatgctcaaacaggttcattccatggacccattcaaacgcactgaaaatcggcactacttacataaaacccaaatatgatgttggaacattttgtaatactgcactttattccttcaccttcccaccattatctactatccagtgcaccatctggatagcattgaggccgaaacacatgaaagaagtcagaatgttttggcaagttgttaaaactattctagtttgagcacacatactctgagatctggtcgccgtattttcgtctgatagttgcgtccaactatcaaatgatttaacactgtgctgcccagatcatgaaagtaatctaccgtgaacagctagtagcttaatataaccactaactaggtaacatgcccatttcaaagataatcatatcatagatatttttacgtttgaaatgggcatcacgagctggaattactgacatctgctggagatatagtagtactgaaagaacggacagagatcggacagaaagcagaaagaaatcggatggcggaccacagttgagcaggaaagcactgaacccaacccggaaaagctaaacgtgaatctgatcaaagatcaattttcatcccatctgcattcgtcatgcaacttcagcttaacgactgaagagaagcatcagagaccaaggttagtcagaagacctaccccatggactgaaacttcaaagtccagggtgaactatctttgactaaactgagcatcttagttaacaaaaaatcgggcagagacccaagttagtcagcagacctaccccatggactgaaacttcaaagtccagggtgaactatcttctactaacctgagcatctcagtcaataatacaaacatccgagcaggaggtgttcaattggttctcaaaatcacactctctagtcagaaggctaacatcgtgactgtcattctaagcgcatgcaacacttagccaagtcccaagatagtaacgtatctaccacaatccactataagttagtaaaagaaacacagaaaacaggaagcagagtaaaatcagtgtcatgacttgatagtattccaggcacggtcatccagccaatcaattgatccttccaggcttcacgacatctcatcctttagcaccgaggttcatacccttcctgaaacaaaatgtagcacccctcctacaagctcatgaaaggaagaacaagaccaaccatttgcgaaaacttctatcttgcgaatgaatggttctgtgttcagaaagttgtcacaaacgctaaaggaataatcgccttaccattggagcacggtttggagcagcacgagaagcaaacgtcttgcaccatcaaaatagatgctagactcgttttacgccttggtggccgatatatacggcctatagatatggccttcatagtggcaattccttgacagtgctgcccacatcgtgttaagaggaagagagcacaaatagagaacttcgctcctatgaccactcaatctggggtaagattacatcagcaattagattccacatttccccctcccatctacacttatcgggaagcactaaaccgttgaacgacttacacactctacaaagggcatatgcaaccaacgagcagacactacaacagacaattaactccagacctcccattcactatctattatgcatcatctatctatttgaatgccttatcgtaaccggtcagggtgaacctatacttaacgtcattgttgtggcatctctccagtccttccttcagcccttcctcagagattgggagctcctcataccaagaaccaatgcccttatcagcagcaagtttcagcatatcaagcatctcctgtctgttccccaagtgggacgatcccaagtagcaaccgttcttgataaagcttccagcagacagcgtgaatggctcctctggaaggccgacggaaatgagtttaccatgaaccttcagcacactgaggtaaccatccatatcaaagttcgtggccgaatttccacacgaaatgataaagtccagctttctgccaatcttcttggcccagtctttgtcctcccacgtcgcaataaaatggtcagttcccaatttcttagcatcagcttccttgctatgtgttctagaaaacgtgtacacttcgcaaccaagagccctagcccacatgatggcaaaatgtcccaaccctccaattccgatgatacccaccttctttcctggaccagctccatttcttaccaacggagagtacgtggtgataccagcgcacaacattggggccacagcattagttggaagttcatcaggaatagggaatacaaagtgatcgtggactctgatgtgagaggaataaccaccccatgccttgtcaccatcaggataagtggcattgtaagtgtccacccattgaggacagtacgtttcgttgttatccttgcatgtgtcgcactctagacaggcccaaacttgagctccaacaccaactctttgcccaatttcaaatcccttcacttttgggcccactctaacaacctcaccaacgatctcatgtcctgggatcacgggaaggtctggttttgcccatcccccgcaaacagtgtgaacatcactcccgcagataccacaggcatggatcttgacatcgatatcatgttcctggaacctttttggggtgaattctatcttcttggttgtggaccattttgcagtgtcagtgacggcaaatccttcaaaggtgtctgggtacgccattgtttggtttttactagttttctggtgatatacctgatgttcaagcttaatataggtaatgaagcgtggggatttttttcacaaggtgggtgcaacatcgacaagtacacccgttgcttcaggagttaagattgctacccatcctattagtagggtccaagctttttcgtgctagaatcggaaaatttgcgtgggatggcttatagtggggttgctgcgggtatattatcccactcgaaactggtcaaaaggctgaccttcataggagctccagatcatataacatgaaaggtacttgctccctccattgaaaccatcgacgatggtgtcatataaagtcctttctggcggggtttattctccactgcccacatttttcaagaacgatgccaagaaatctctggatctagaggctcaagtggcccatgcaagacatttgtatgatagtggcattaagggaattttagtcggaggatcaattggagaggccattcatttaacagaggaggagcggttgacattgatacgtactctccataaggctgtccccgaatttaccattattgctggagtgattggctactgtattgaggatattattcgtcagatctccgttagtaaagagaatggagcttcatattcagtcattcttgtaccagggtactacggcccaagtttggtatcccaaaaggggattatcagctggttcaattccattgccgataaagcagaattgccaattattctgtataactatcctggagtgcaaaatgggattcagctcacttttgacagctataaggaattatctaggcatgaaaagattgtcggatgtaagttgacccattacgattttactctttacactttagttgggaaaagcacggaattgagagataataatttctcaccatttgcaggggtagggcaagttttagtcccagctttaagtgtgggaattgagggagtcatcgacggtctttcaactgtgttccccaagtccatgatacacctgttcaatctttatcaggaaggaaaaactgaagaggccagtaaattgcaggaactggtcactgccgtaaatgaaatgacagctgttctgaatctgctgggaatcaagtatgcaattaagcacagattcggcctaggagagtcgctagtgggtcgtccaccactagatcaagaaattgatataactgtgtgggataagcattatgaggactttaaaaagttggaggcattggaggagagtttataataagttcatagagactcaataaaattgcccatcaagcatctgggccattttcatgcgctttactcctggagctttgcttacagctttcctcattaaaggtggggttgatttagtttgtaagatgttccttcattgacccaaaagggtaatcaccgttcatattacaagcaagtcagatctcaagctcaaggccctaaagttcatgaaaccatttgtgctagcaaacaattgcgtagtaccgaaccttagcccagcctgaactgcactgtgtaacgctgcggtatcgaatttttcctgcttcactcaacggccccaatcgccctacaaacaatatcccgaaaccgaatttaatttcctcctatttataatatcatatctctatctatctcctatgcaaaaacagtcaatggactcaccatcgattaatgtccaccggcttcagtatcatcgtggtcaccaacatggaacacatcgtcgaactcatcgtcgcatgggatctcaacctcgctcaacagcccagtaccaacgtcatacataagtccgtaaatctccacgtcttggttctttaaagctgcaagacacgatggatgacgtttcaactgttggaccgagttgatcagattcagacgtgcaagtgtggcacacttttctttggggtccttgattaaactcagctctttacgattttgcgctctgacatgacgtacagggttcaaccaaagatccaatactcctccaattctcttggaagaaagggcagcccagactcctccgcagtcggtgtgaccacaaacaatgatcttcttcaccttaattacatcaacggcaaattgaatggctccagttacggagaaatcgttcgaattaacgatattgcaaatgtttctatgggtgaaaacttcacccggcattactcccaagcatgcctcactgattctggagtcagagcagccaatccacaatgtgtgtggttgctgacctgtaccgttggactcaatgattgccggagaatactcgttgatacgctcagtagccaatctgttctgtttcaagaaatccgaaaggaccgactgcttgttgagcttgaaaggaacagagtccaccggaggtggtgggggaaccaatgactccggattaacgaccgtattattaatgtctgggtttgactttgtgctggaagttgaaccagacaatgccatcggaacgccttcgacagtttccttcacttccatttcgggttctggggttctaatttcttcttgttcaattggattgtctaagttttttaagatgcttgtgctttgacgttcaaatgataaaccacccattaccgactttatagacagaaatctcttgacagttgagttaacgcacaacagtttcacacgacaagaaaaaaaattactcgttgcgcaaacgggactgtggccatatataagctcatgggacttggcggcacattgtgtattagtcaatctgttgagtcgcaacttttctttgtaagtgctgtaaagatggtgatatcacatacaaagttgctgcaaggtgagagacgtcatcctgaatgattaacgcacgactcaacagttctctggcagataaagttttgagggattttagcagaccgttttaaaaaggggaatcactgcaggaacgttacaaaccaacagctgtcctgaatctttgaaaattgcctgtccattggcgccaatactctttgtggtctgacggtttctggaaccaaaaagaaatgcacaatcagctgttagcgaaaaaaacaatagctaaagagagttcctcccaccaattttgggggtttgaatttttttttttgttggttcctacggtgaggtaatctacttcacgtgatcttggcaatcggccgtctcgtcttttgagtattttttttttttctggttaacatcattgtcgcgggcccgagtcccctgcgttttggctagcaattggatgctctcgtagtcggccgccgccgggtaaaaaccaaattatgacatcacgtgaggagagcctaagattgccaaaaaaagaaacgtcccacagatgattgcgatttcacatggtgcgccgagtagatcaagtgatccaaacatcatcgtttccccagatttcccagtgtacacaaacattcgttaattgtacgcataaaatttttccgaaattcatgacccccattcacctataaatcccaagactcttttcttttcctttcacctagaagaatatcagtttgaaatcaaataacaatgaagctattagacggcttgacaatatctttgtgcataagcatggccacctcgctggtgttgcctggctttgaccaacttagattacagcagcaaaatgtattatcgttactcccaaaggaaaaaatccagatccaaacactctcagagatctggtcttatgtggattgcgctattgcctccttgggaccaaaggagatcgttatcgactcagacttgtcgattttgaagcctgtccaggcttcttctatccctagatcagaatttaatcaatggttgctctaccaacgaaatgtctcatttcatggtgtgctcaacaacatcggaggatacggctataacgcagacaacgtttctgtgggatgcattatcgcctctccttcgaagtcttctccaaactacttctatcagtgggttcgtgatagtgcaatcactatcaacacagtgatagagtatttgtatgacgacaacatagacgattctatagacaaaagtgagcttttagaagccatagacggctacatcaacaacattcatcacttacaacgtcaggacaatagatctggtaagttcaaagatggctacgccagtctgggagagccaaagtttatggtcaacggtgaccccttcaatgactcttggggacgtccccagagggatggaccaggacttcgtgcactatccgtggccaactatattgatctgctggataagctgggaattcagaaagattcagaaagactctcattcatctacaatgaagtattgaagccagatctcacttatgtcaccctctattgggaccacgatggatttgacctgtgggaagagactaatggattgcattttttcactagtttgactcaactgaaggctcttagaagaggtattgaactggctctcaggtttgaggactacgaattccatcgtgacctgaagaatgcttatgcccaactaagaaactttattgttggtagagactctggattccaagatcctcgtttccctcatatcattgagcaccctaatttggtagacgctccagcccatattagaagaaatggtttagatatcgcaaccatcattgctgcgctgagatctcacgatgttgatgatgcaggcgatatagtcaacatcccgtttggcgtggacaatgcaagggtcctcaattccctgacctatttggttaatgacatgaagttccggtatccactcaaccagggtcgtatcgtccctggtttaactctaggaatggccttaggaagatatcctgaagacacctacaacggtgttggtaccagtgaaggaaatccatggttcatttcaacttccagtgcaggtgaactcatctacaagctgttgtatttgcaatacaaatatcaacaagacttcgtgatagattcttccaatagggaattctacgaaatgtttttggatctgcccaaagactctgctcgtggaattcaaattcgcatacctttcggaagcgacacctatcgtgcactgtccgtttctttgatccaatatgcggattccttcttggacgtgatcagggaacatgtggataacgaaggtcaaatgagtgaacaatttaacaggtacaatggttatatgcaaggagccgagaaattaacttggagttttggttctgtttggagttgtctccgttggaggaacagaatactaaacttacttgcaacaattaatgaatagggtgtaggttttggacatgaatactattggtagatgataaagagtgaggtcgtagcttgtagtaactgtaatcgttaaggggtgttcttgatgatcttgtatttgggagagtggcagagtgaaattcagaggctggactatgcagatcccaggaagatgcctcaagatcattcgttgcagaaactcatctcaaaggtttcctctttcaccccacatgccgccccgcgtgcattgtacatcggtttgtcgcgaccctcctttcctcacaaattcacttacattcaacatccggcatcgtatcaccgatacggagttcccgcgcactcaattcggtcccgacgctgcccgttcaacatctcgcaacacctgtgcaacacctttgaccttttaatcctctaaaatttttttccaatcaaacataacattacaatgatgcactcagtctcaaaaagagtaagtagcccttcaattttcgtggcgttttgaacaattcttgctaaccaaaaaagactctggcctcttcccgttttttcactcgttctttggctacaaccattggcgacaattttggccccaagaagtacggaggaaagtacacggttaccttgatccctggtgatggtattggtaaggagatcaccgactctgtcaagactatctttgagcaccaaagagttccaatcgagtgggagcaggttgacgtgtctggtgttgattccgacaaggccaagattgacgaggctgtcctttccttgaagagaaacaaaattggtttgaagggtatcttgcacaccccaaacaccccggtcaacaagtcattgaacgttgctttgagaaaggaattagatatttttgcctcgttggtcttgatcaagaacattccaggtgttgagactgccttgaaagacattgacatggttttggttcgtgagaacactgaaggtgaatactctggattggagcaccagtctgttccaggtgttgttgaatcactgaagattatctccaagtacaagaccgagagaattgccaaatttgcctttgacttcgccaagaagaacgacagaaagctggtcactgcaattcacaaggcaaacatcatgaagctggccgacggtttattcagacagaccgtcaaggaggtcggtgtcgactaccccggtatcgaagtcaaggacatgattgttgacaatgcctccatgcaggctgtctcatggcctcagcagttcgacgtcctggttactcccaacttgtacggttccattctttccaacattggagctgcactgatcggtggtcctggcctggttccaggtgccaacttcggtagagagcacgctgttttcgagccaggttgtagacacgtcggacttgacatcaaggacaagaatgtagccaacccaactgctatgattctctctgccactatgctcttgagacatcttggactagacgcccatgccgatgctatctcatccgctacttacgccgtattagctgaaggttccgtgagaaccccagacattggagggtcaagcaccaccacggactttactgaggctattctgaagcaattggactagagatctagccctcctacaatagatcatgatcataaaggaacaagaatcaaatgaacgaattttacatctttacctcatcaccgcgatccccatcgtctctatcaaagtcctccctctctcgtagtattagatattcctcatctttcttccttgccttgtttcaccttttaacccgcctaattccctctaaccaaataagcatccgatgtcctacgtatcggacgtcgagttttatctgaaattgcagaagacgcagtttaagaccccaattgaggccgtcaagcgcaacttcaaggcgattcagaaactcattgagaagcagtccgcccttttgtccaggcacttgatccaattgaaggagctggaattgaacggccagctcagcaaggagatccaaagggagagaatagcagtgctaatcaacatccaaactcgatttcatgacaagctcgtcactagagttgaagagcataacgattacgtccagcgattagaaatcaggctgcaaagattcaaggacctggaaaagatccttgaaaagggtaaaaacagctcgtctgattttggcgatgactttttggcatggactagagatcaaattaaccttttgataggctgctacttgatgaagaatttgatcaacttcaatggggacatatctcagaataacccaggactcgaattgctgaagcatttgaaactcgataaactcattgatcatgatgtcatcttgaaagggatatcgatttaccagaagatcagatatgaaaaagatttgagtgtgttaattgactggtgcaatgagaacaagaagatactgaaatcaatgaaaacgtcctcgacctcggtagacgactccaatacgactcagaaggaccagtatcgtacaagcttagattttgaaacattttaccaaaactttatagaactgatcaaggaagacaagatttatgaggccttgattattgccaaagaacacttgatgccacaggctggcccggaagtaccttccacaagtaattccgcaacaacatcatcggctacgtcttactcggacaaaactccaaagtacgacagcacttttgagaaattcaaaaagtcggctggtttgcttgtttttggatcattagatatagatgaactctttgggttgtctggttctaaagtcaatagcagcagaaaggattcccttactaactctgcgatgtcagtatatgacaccttttcaaacagttacaatcaaattaataataaccttaagcccttcaaggagctcttaaatgacgaaaagtggattcaattggcagattttttcatctacaactataatcacatttatggaattgaccagagcctagagctaatagtcatgctaagtgtcggaattacgtctctcaaaactcatagttgcaatggattcaagaattattctaaacatgatttccaagaccctcaggttacatttcaagatgtattgcataatatcgaagaatccaatgacataagcaacgccaaaagtgaactgagtatcaacgatctcaataaatgccccatatgttcgcttgagctatacgagattgcacaacatttgccatattctcatcaaaccaagagtaatatatatgagaatccggtaaagctgcctaatggacacatttaccaattggagaaacttttgaaaatgaacgaagcatttgaaaaaccagagattgaaaacctcgatgagatgtacatcaaagatcctttgactaatgagatgttcaaaaggtcagaacttcaaaagatttttcctacttaattttccttggttttccaattctctggtacttttcaaaaacgtacatgcgagcctttctattcgtaggaggtcttgttgtctctttcttgccaccaaccgttgttctatggtggtattccggataaatgtcccaatagaaagcaccagatcgctgcactttatagtcaattgagtctctggccaaatctcttacttgccacgattggtagggttccccttcgaaaagtgagactacaactttgctgtctttggcttccgttgcctttttgggggaaggtttatgttcgtcatcttcatcatattcaaagtcatcattgtgttcttgaagttgtgtgtagtggaccgggattgattcttgtggtgggagtgaacgtttgacgactttgtaaaaatcttcacaagattggaaaaacttagccaacagcttttggtgggctattgtatttctttctatatccttaataccagtaccaagatgaggaaagttgaagacaatgtagttcaccatggaagtccaacctctcagtcgactcatattctctttacggctattgagcttaaagctacccacaagatcttgggcatctatgtcatggagaactagcacgttactatcccgaaggaacttcaaggtatcctgaacgttagagcctgagtacttagaaagggtatcggcctcgctgtccaaagatgttgcgataagattctcaggtttcacgtacgattgagctactagacttttggcaaaggtaaaatcaccttctccaacaagaataactttgtcatcctgtttgaaaggctggaatttctgatgtaatggaatatcctgtaaaggtttcttcaatgggtcgtctttggaactgggagaatctccaagcttgggacgactgttagcaactgttttcggtttggtgaccttggaagccagtaaatgtcttgcgagagcacctgcaagtcccttcctgttcggctttttactcagatttttcctagccatgcttctcttgcgaggtatctctaaagaaatttttcctccaagaaaagtttcgctgtattgtcaaaattagtaatgcaggagaaaaattgttccagaacggaacaatgcaaattcaaaactgcttaaagtagtgtgcattgcaataacaatgttccgcgatgtctccgtctttttggtgataaagtttgttgtcgctcttatgatcagtgatcggctttaactctgttttatcatatccatctttctagttaagagtacttcgctggttttgtcaagaagtcaccatgggaagggttgatgggtcgaaacggatccggcgctcctacaactgcggaccgtgcaaaagacaaaagataaagtgtgacacgaacttgccctgtagtaactgtgtgaaatacaaaagagtcgccaaatgttaccaagagccgcctaacccgccaacagaaaaggaggtcctattgaaacttaggaagaaacggcgcctagagtcgaaagataccgttctgttgccagaggtaccctcgatagggtatcccaaaattgagcccgaggtacagcaagcttccggcagtatcaataatacccctattattccagatcaggtccctgttgtgcatagcatgcccctatctatgcggctagcacagcagattcctgtaattcagacacctgtcgaaatgttggtttctgatcggcaaccaagtagcagtttatcgtcgcgttctgaaaactgcagtggtggtccactcattcctcctcagctctcttattcagatagccaggcatctgatagacttccgcaagcaatgtcaagtttccagtcagacgatatattggtgggttccacgcttacggagattgattctcgaaacatcaataccaccatccagttgttaaagaacttgtcgagaaagggtcttcccagccctgacgccatacgttgggcctttgatatctttttcaacaatgtcaactttatatatggtggcatttcgaaggctgtagtagaaaaaaagttggcagtgttcctccagacttacgaagacgactcgttagtcgatcagctggacttcgatttcatatctttcgtttattcggttctatgtgtttcattaatggttggtcatggcacagaaggatcagctcctgtgatcaaccggttacaagacaggtacaatatgtcccgacttgccctcgttgacaactttttcataaagtcacgaactggtttgtttcttctgaaccttttgaaaacaacactggtcgttgacaaggttcaaacccttctcactctaatgcacacgtctatggtcagtaaagtcttctttttgatggcgagccctcgaagggatgattactttgaacaattgttgaataatgtatctttgatcctgttgagacagttgggcaataaagcaacctacaacgaggaaaatctaccaggaattgggtttgatctagtacttcaagaaaaaatgaagtgctggtggtggacttgtcaggacgatacggagaacgctttgttatttttcaggaaacctttgttgcgtagttttgatagtcaggtacccttcccactgaatatcgatttggacgacagtaaagttacttcttacgataatatctacgcctataataatgtggggtaccatttcattaaagtcaagtcactaaagattctcaacaagctattttatgtgaaaagtataatcgacagctgccaacaaaaacattcgtcatgcgactgcttccgcagtctttcattgttgagaacaatggttcgaatagatttggagttgagagagcaaagtaagatccctagcatattcttactagacgacagcgacccagaggttttgaaactggatgagaagcgacaaatacaaagagccttccaacgatttttaattgtgcaacatctttgcctgtaccgtttcaaactatatcaatacagttgcagattcaataatggtttgatgaatactatttgcaaaatactgattcttcaactattatggatgttggagtatcaaattgaccattatcccttttcaccaaaaacagcggtgtactacaggctggctgttcctcgcatggtgtttaatgtcctgactgggttttcgtttatcggtattaccggagccaccttgactgtaagggaacgatactggactaagagagtaatgcgaaaggcaacagcgtttctggcgaacctaatcaatgacggttacgagtttactactcctaaagccagtcttattttgctagagcgagtcaacgcttacttaaagggccagggacctaattatgacatcgattttgacgagcaggaggcgttcattaaagaaatggaggagttgaggacctctggtggatatgagaacagatactcatattcaggaaccgatgaaacacccagagatccgggttgcctgtttcttcccattgctttaaataaatggcactttgatgtgctagactgcctgaggatatacggtactcaggaagatctggaatctaaattattaagtgttcagcaattggtgttacaatgttgcatgaagcacagtggcatgactccagacatggtctttgcaacggaagtagctcagaagccgaccttcgaagacgacatagtttgtgatgatattgacgcttatgcccaggggggtgattgtctagattattgttacacgccaagcaattactccagaactttagaaattcatggcaagattgctaccttacaacgagagctggggctatgctataatattctcggaattttggaccgtttttccgattaaggtttttagctccattgcgccaacccccgctctccagactccttcgttatccagcattcagcatggacaggttcaaaaaataaaatttcttgatatgggtccacttcaaacatgcgcctacctgtaggaaaaaaaaagagaacataaatatgccgcgaacagaaaacgtaatgtactgttctatatataaactgttcagatcaatcataaattctcagtttcaaactttccgctcagccagattttattcgtaaagaacgcatcattggctctatgttgaaggatcagttcttgttatgggttgctttgatagcgagcgtaccggtttccggcgtgatggcagctcctagcgagtccgggcataacacggttgaaaaacgagatgccaaaaacgttgttggcgttcaacagttggacttcagcgttctgaggggtgattccttcgaaagtgcctcttcagagaacgtgcctcggcttgtgaggagagatgacacgctagaagctgagctaatcaaccagcaatcattctacttgtcacgactgaaagttggatcacatcaagcggatattggaatcctagtggacacaggatcctctgatttatgggtaatggactcggtaaacccatactgcagtagccgttcccgcgtgaagagagatatacacgatgagaagatcgccgaatgggatcccatcaatctcaagaaaaatgaaacttctcagaataaaaatttttgggattggctcgttggaactagcactagttctccttccaccgccacggcaactggtagtggtagtggtagtggtagtggtagtggtagtggtagtgctgccacagccgtatcggtaagttctgcacaggcaacattggattgctctacgtatggaacgtttgatcacgctgattcctcgacgttccatgacaataatacagactttttcatctcatacgctgataccacttttgcttcaggaatctggggttatgacgacgtcattatcgacggcatagaggtgaaagaactttccttcgccgttgcagacatgaccaattcctctattggtgtgttaggtattggactgaaaggcctagaatccacatatgctagtgcatcttcggtcagtgaaatgtatcagtatgacaatttgccagccaagatggtcaccgatgggttgatcaacaaaaatgcatactccttgtacttgaactccaaggacgcctcaagtggttccatcctctttggaggtgtggatcatgaaaaatattcgggacaattgttgacagttccagtcatcaacacactcgcttccagtggttacagagaggcaattcgtttacaaattactttaaatggaatagatgtgaaaaagggttctgaccagggaactcttttacaagggagatttgctgcattattggactctggagctacgctaacgtatgctccttcttctgttttaaattcaattggccggaacctgggcggctcctatgattcgtcaagacaagcttataccattcgttgtgtttctgcatcagataccacttctctggtattcaattttgggggtgctacagtggaagtttccctgtacgatctacagattgcaacatattacaccgggggaagtgccacgcaatgtcttattggaatattcagctctggaagtgatgagtttgtgctcggtgataccttcttgaggtcagcctacgtggtttacgatcttgatgggcttgaagtgtcgcttgcccaagccaacttcaacgaaaccgattctgatgttgaggctattacctccagtgtaccttccgctactcgtgcatccggatacagttctacatggtctggttctgccagcggtacagtttacacttcggttcagatggaatccggtgctgcttccagctccaactcttctggatcgaatatgggttcctcttcctcatcgtcctcttcatcgtcctcgacttccagtggagacgaagaaggagggagctccgccaacagggtccccttcagctacctttctctctgtttggtagttattctcggcgtgtgtatagtatagtataaaagggcctacattggataggcttcaacattcctcaataaacaaacatccaacatcgcgcattccgcatttcgcatttcacatttcgcgcctgccttcctttaggttctttgaatcatcatcaatcgtcgccgtctacatcagagcaggacttatctttgccttccccaaaaattgccactccgtcaaatagattcttttgaatccttgactatttttgcctaaataggtttttgttagtttttcttcaaagcccaaaagaaactctatttagattcatccagaaacaatctttttctcaccccatttcgaagtgccgtggagcacagacataaaaagatgactaccgttcaacctacagggccagacaggctcaccctgccgcatattctactggaattcaacgatggctcctcgcagcatgcagtgatcgagctaagcatgaacgaggggattaatatatccacccatgagtggaatccatccactaatgagcaatcgccacgggaagagagagcaccaccccaacaatccaatccatcgcatcatccagaatcatcgaacatagctactcaaagtcccgctcaggaaaccgagactcagcccggcattccaggactagataggcctgcctttgatacctcggcaacggggtcgtcagaacaggttgacccagtacagggaaggatcctggatgatattataggccaatcattaaggacttccgaagaagacgataccgaatcccgccagagaccacgagaccagaagaacattatgatcaccgtgaattacttgtacgcagacgacacaaattccagaagtgctaatacaaacaaccagacgcccaataacacttctagaacttccgacagtgaacgtgtgggctccttatcgttgcacgttccggatctaccagataatgccgacgattactatatcgatgtactcattaaactaaccacaagcattgccctcagcgtcatcacgtccatgatcaagaaacgattagggcttagcagggaaaaatttgacgaactcgaaacgccttccttagataccgtgcatgatattacctgtcccatctgctacgatgaatttgtcgcagcgcctaccaagccccaaccgacagatactaatcaacggaaaagaaaaagagaagatgacgatcatgatgacactgatagtaacaagttacgcaagaattccgaaaccaagaaaactaatctctccactaaagttcctcccagaaaggagtacacgcattgtcctgtaaaagtaccttgtggccatatctttggtcaaacctgtttatacgaatggctcaaagaaaacaatacttgtcctctttgtcgaacaaaggcaagcaatgtaggacatggctcagtgatgcaagatatcactttgaggttaccaaatttggcttcaattgtatatgagaacagagacttcatccgatctatgcgaaactcgggacttgcatttactcctgttgattatggctctccaagagctacaactgccacagctgcagttgcagcggcagcaaccaccggtgcaaccaattctactcccaacactagcgttcaaaatagaccgttgcgaatgatacctctatttccagggagaccggatcttggcctagctagaggtgttactgtgccggatgtgattcgacgtataattgactcactcacagacaggattcctcgaagaaatgtgcgtccaacccccgcagcaccaacagcaacgtcatcacctgttacaggttccaatacaagtggctcccagcaccaacgttcattctctgcggtgagagctccttggaaccctgtcagtgctatgatgcttaatgaagttctccaaagcagatgggactcaggatccccaaatagtaatttattcccagctggagttgccagcagacgaaccagggatggagtagttactgaggaaactataccgcaacatgctgctggtccagttccagaatcaatatctcagggtgaaaccacaaccaatcatgaacaagcatcgtctcactctgaaacaccaactcatgctcaaacccaagatcaagatacccacaataatgaacctgaggcctaattttgaggaaattcgtataattgtatatctcagtctataaatttgtctcaatataaacggcatgtttggacagcactgtcacagtcttgaataaaagtcgccactctaatggatctcctttcgattttataaactcaactttacggagagtcaaattggggattaattgggagattcttatattgcccactaaggccattcgccttctatcccaggctcttattggaatatataccgattgatcgtcttctggaataaattctaggtatttttcttgttgagtttgcagtctttgatcccccttgactccgatcttagtcaatgattccattaaaatgctcaccaagttctccagatcaagaatggaaaagaaccgcgtaaacctttctgaaaagataccgacatcagccgtgaaaacatctcctgtgtttataggtctttgaccttggttgataaattgtaaaattgccggatctttggacactaatcgaatgatttgatcctcaggggtgctttcaccaagtttgacctctgtcttttgtcgagaatgttcagatagaggctgctgggtagctggaaaaacacaatctgagccagcaaaattgtccttcgtattgctccatatatcgtcaatcactcccagcatttgaggctgcgtagagggagcatttgtttggtgattttctctattattgattgagaatagaagattttgatattttttgtcttcagaatctagtccaacgtttagattcgacagaagtttttttgctaaaagtcccgagtcttgacataaaccatcattgggattagccaatggattttctttcatgacccaccgatggtccatgacatcactgaccgttattctattcgctgggttcggcttcaatactgccctcaacaaagatagtgccgatggtgaaaacttaccccagggtccagagatcaattttcctctttgttgtaagaagttgacaaaatcaggatcgtattcagtgggctcatcccacggagtttgacctgacaataggacataaagtaagattgcacaagaccacaggtccgacaattcagcgtcgtacgtggttgaataagctacttctggtgccatatatggaggggaaccgcatggagtatttaccagtctctttttaccattcttctggaaaacacacgccaatccaaaatctgccagtttcaagtttcccctggaatctaaaagaatgttttctggcttgatatccctatgagctaccccttgaccgtggatatatctcactgcacttagtaattgacaaaaaaagaaatgagccacggtgtcgtcaacacccacatctggttctattttgtcgaacaaatcaccattgtcggccaattccattataagatacagccagtttgggtcttcattggcgtcataaagtttggtgacattgggatgattactgcagtaagcttgaatatttacttctctgctaacctgagatgtggataaccccgatttgagggcatactttttatgaatcaatttcacagctactagcttggcgggatcatctttgaaacttgcagatttaacaatagcaaaagagccctgtccaagagttcttccatactccaactttggaatgctgggtagggcatccatctgcgacagcctcatggagaaggacattcctttttccggacgatggtgatgacgatgggctgaaagaatgtcagagcgggttgttttgatgtgtacatatatctatgcacgtgacttagataaaacgtttacgataaccgattcatcaagctattcttgtccccacaccctctcaacaagatgtacaatttccatactaggtcgggttctgtgaagtacaaggacaggctgcatcagaaagaagatttggggcggttcaatgctggaactagcagtctatcagaggacaacgatgagaacttgattgcacaggtcccggaaccgataggggaaacgatagccagaggtcaagagacacggaacaaccagagtcggaaaaccccccagctgcctcccagaaaaccacctcctgtagatataccggctggtggtcaattgcaggagataaatgagaagcacgacaactcagtttattcatcaaagagatcatcggaaagggaggaggcgaaatcggaaccttccatacaagaacaaatagactcaataagaagactgaataataacttaaaggagagcccagttttactggacgatgaggacgattcagagttgatcttcgcttccaagaaagttgtgcgacatcttactaaagcgtacctagttgagagaaactacacatcagaagaagagttcaaagtacatcagttttcacttggacagaaattttggaaataccacattctaagcattggaaaagatcgtttttatttgagcagcattccggaaataaatcatatgtgttgtcgatattctccagggtttttcgtttccatatctcgtttcagagatgaggatggactaccagcgtacagaatgacaatcaaaggagaagtcgacaactttggcgataggctactttcaatctcagagcttcctgtagtggccgtaattacaaagagagtgaaaactggatttgatatccaaatcacaaaaagttatgcattaaaagaccgtttggtaaggtttatcggagaaggtgcaaaggtcaatggagcaacggaatctttggacataccagagcttaacgctttggattcagaggatgttgggctcaaacaagttttgaacagatacaagctacatatggaaggaggatcgaaacaatcatggattgttagtccaatactcagaaaatcccgcaagatgtctaataagttgggcctttcacagacagtctacaagatcaaaggaaaacgcaatattttcttctacaagaattccaagaaaggagatgggattttcagtgaggaccccaaagatgtggtaggattattccgaccgtcccaaactaaactaaagaaaaagatcataaaaggagcagcccagctgaaacatctggaacgaagctcttacatttcaccccaatcattgggcatacctgatgacccctcgaccaattcagttcaacggtattatcgagcggcagatggatacctagaagagttcccaaaagatgactcacccaaccacgttaaacttggctggataacgatctacgagaataacttgttcaagactgctaacggcctttgggagttatgtttgacaatgactctgacagcaggacttgacagggtcatctcgggaacttcgtgattctgactcttccttccccaatcgatgcgcgaacattggtgagagagggagaaagaaaaacctcttccctcccctctatttcacgtcaaggactctactattgaaagaaaagcacaacaatgttgaagtgtcttagtcgtaacctgcaaaggcagcctgtcatcaggcaaagaagtgctcccgcggctgtgttgctgcgtgcttacgccattgacaccaactctcaagcgttagtttcgaagcctgtacaggagattgaccctgagatggcacaaatcttggaaggagagaaacaacgtcagaagcactcaattactttaattccttccgaaaattttacctccaaggctgtcatggatttgttgggatcagagatgcaaaataagtactccgagggatacccaggcgaacgttactatggtggtaacgaatggatagacaaggcagaaagtctttgccagaaacgtgccttggaggcatttgagttagaccctgctcaatggggtgtcaatgttcaaccattatctggggctccagctaatttgtatgcttactcagccgttctagaagttggagaccgtttaatgggattggatctgcctcatggtggtcatttgtcccatggttaccaaacaaacgctaccaagatctcttatatttccaagtactttcagaccatgccttacagattggatgaaaatacgggattaatcgactatgatgccttagaaaccagtgcagttttgttccgtcctaaagttatagtagctggtgcttccgcttatgctcgtactattgattacaaacgtatgcgagaaatcgctgacaaagtcggtgcctatttgttatctgatatggctcatatttcaggattggtatctgcaaaagttacggaatccccattcccttactccgacattgtcactaccaccactcacaagtccctacgtggacctaggggtgccatgattttcttccgaaagggtatacggaaggtgaccaagaagggcaaggagattccatatgagcttgagcgtaagatcaatttctctgtgtttccagctcatcagggaggaccacacaaccacaccatctctgctcttgctgtggctctgaaacagacccaaactccagaatttgtttcctaccaacaagctgtggtggacaactctaagtcatttgctgaatcgttcataaagagaggatttcagttggtgtctggaggaacggacactcatttgatcttggttgatctacgaaacaagaagattgacggtgcacgtgttgagaatgtcttggagaagatcaacattgctgccaacaagaacactgtaccaggcgatgtttcggctttatttccttcgggattaagagttggaactcctgcaatgacaaccagaggatttactgcagcagattttgaccgtgtcgcaggttactttgaaaaagcagtcgcaattgctattgacctcaaatccggagaaaagggatctttggcgaaggaaaagctggctagtttcaagagtctcgccgaagacagtgcggaaatcaagaagctggcccaagaagtcagtgaatgggcttctacatttcctgttccgggggaattgtagaaacaattaaactataggtgccttacttaagattaagctttgtgtctcttctgatcgtattatgcaatatctattgatgctagttggcttccagatcggtgatcagtactagtccccggagagctacttttttgggattggcacgtaaacgacctttatgagcctcaatttttctcctgacatctaacgaactactcacgtgatcccttaacctgctgcttataaattcgccaaatattccgaaatcgaggtctggattgtgacttcaaacaattgaatcgcgaataaagacaatacaagtctggcgccataacctgcaaaagtatgcactaataaatacggtagtgtgggactgtaggtcggggacatgagtggctatgatgtaaacggcggcggagtcggacggctgctggagcgagtggaagagtaagactaaataaacactgttacacaaaaaagcagaactgagccagccctatatagccctatctctctctttatagggccaatatcgcttccaaagactttctcttttaaagcaagggcgcaagaaaagagggaacacaaaataaaaagaaataaaaaatggaagttgctactctatattacaatatattacataatctggcgtggcagagcacaccaatcagccgcacagagtgataaaagcccaaacacgacacacatcactgaagatcctcactacctgtagatgacgagcgccgccacttgaatttctttgtgctagacttgaatgagccaatgatagtgccaaacgacggacggctagatgcagatgtagaaaccgacgagttccgtttgaagttgagattggtagagctgttgaaaaccgcgtcgttctcatacatagtctgcccctccatctcgttatccgaagagtaaacatgcaagttgacaaagtcgtcttccagagggtctaggccctctacgcccagtgaaggaaccttctgaaatgagctcagattgttcagtgatgaggtctggctgacgaaatggataaaactatcatgcaaataccgttccacaatgttcatcagtgtagaaaggacatgggggcaagggagggtttcttgttgggcggtttgcaggagttcgttcctgtacttgctaggaatgttgatctcttttggcgagtcaatctcaatgtagctggacaccagacatttgaactcgaatagcaagtctgataatgaggggacatcttcattagtggtggacaaattatgtttctcttcctcggcagcctttaactgctcgatgcgcttgcacaacagcattgtgtcattgtggaactctaggttctccaagcagtggcacttgctcaaaaagtctttgaagttggtctgggagtagggagcgggcgctgtgccattcagtacttggttgaaggtgggcgtaggtgatttaggtgacggcgtgtcccttagcctaggctgaaaatccaccatagccatgtatggagatttattgtgaaggcaaaattgttaaaaagccggctttttaagggatcgggataaagaacataaacgtgtgcttataatcaaaaatataaatcatgggagacggtatcatttgaagcattttgatgcatgcaagattatgcaccatgcatatactcattttagtttgatttgcaacggtcgagaaacttaacggaaaaaggaatagggagacagcgttttgctagcaaaaaggaggggggctttttagaggggggaaacttatcagcttctagggggggtaaaaccctgacctagggggcatgtgacggttgcaccggggtatttcgagcaagctaacctcagtgtaagaccacgatattcggataaagactctggcaggcggagatagagaggaaaggagatcgtagtattgtacgaagccaaccgttctgggcctgaagattacgataggatcaacaagaatcgaatgataccaggcaaccacagaacaacgtgaaaaaacaggccgcacgccttctctgaaatgtaacagtttggtatcatttaagtgttctacccccctccctactcttctttccctcctactctcctccttctgtcatcttccttctattccctctgcggggttgtttcctccacagtttagcctaaactttatgcgaagtactcaagccttcgctctgagtgtcagtgctaatccgtaccaccacaattttattttacacgtctcgaaatgacctcataattttgttgcccacaacaacaattatggttacctagacggcgagacgattacctaacgcgaacaatctacacatgggcctccctcttgattacctaagaaagggcacgctgattagaaatataatagtcctgttactattcaaaaactaaaaatgaccaatcctacacaagaatccccagaccagctgcaaagattacctataggtcgctcagaaggacccaatgtccacgtttggcgtgttgtaggcaacttgcttggccattaagcggaatttctcagagaggccgtccatgtttggctggatcaccttggcctttctcttggaggccaggatcagtgggtcctgtctctcgaccgacagacggtattgtgcgaatgatctgtatgagtgctgatcttggtgcactgaattgactcctgaagcagcctgagcaccactgttgtagtctttgtcgaaggctaagggtcgagtatatgagatggatctaacagcggagcaagcaaaagcgaattgttgtggcttgacgtatcttactaagctaaccattattaatgagactgatatgaagagtaattggacttaaatcagggaatttcacacaatttataccctggcgattttttttttttcaatcggtctttagatctcatggggagaaaagagggggtggcatccgaaaaaattggcccagtcacacccctctttgactctttttcaagctaatttcaaaaaaaaatcgtgaccctcgcttgaattcgccaatcagaaggttgcgcttcaggagtgtgttttgatttcgattcatggaggggaaccaactaagttactgataaccgatctgaaaccttgataggtgaacttttgcagatctggcaacctcgaaggccacgtgaagcggcgaagctttaaatctgtcaactagtgctttgctgctctctacaactaaagggggtcggaagggacccgcggccacagccctgttcttttgcgcgaaccccctattatcgataagcaatgcactatgacagaggaggggttattaataccaatttcacgtgactttattagtggtatgaaaattatttatcagccctgatctaagttgaggcaggcagagctggaagaggatgaactgaaggagtttaggattccagctccacagcatttgattttctggatttctggagtctttttgatccgatcaagaggtgtgattggttgatatgggtgcaaaccgcgcgtcaagcacctgaatatcagtaaactaactgactacgagatattttaaattgacgagcctacttctttggaactattcattcagttgcttcagcggcgtacatcaattgcctttacggtcattttaactaattgatgttgccgtttcacgtctgagcgcatctagacccttatctttcgttctcaggctcacggttttattttcttttttgaggctgttcattctatctcagtcccatcttcagccttgtaattcttgggaggttgcacccaccacgaactcttgcagctatgtgcgaatttcgtgaggaataggtctctactccttgaaaggatttcatggataacccgatcttcgcatttgccaactgcgagcacaatggctgctagtctgagcagcaaagcagtacttagcatagctcactgctcaatggcactgccggtatgctttcctagtattcgctgttcgatactttcgaaagataaccgcagcagctcaagaaagggcgcaaccaagacatccctcaattacttggaattcgttcaattggcggttggcaacggagggcgacgtgaagccatcttccccctcaggtcctaacaaatgtctcagtgcagtaagaagattgacattcactgtaagatgcactgtctcagctgtcagatcgtcttcctcttcgtctctcatgtccatttcttcatagttagcctcaatgtctttcattatctcgtcaactgtatcagagtcaatagcatgaagcttgaacacttccaacaatgactccaacatctcgtctgatggagaataatctaattcgttgacttcctctaaggaacctttcagcttatctttcacgttatcgtatagtaacgttccatttaccgctttcaattttcgaaggtaatctcttttagggaaaggtgccttggtctgggctcgcagaatctgcttggtggatccaaatccatagttatttcctggggcaagaacataatccgacgtacccttctggatactctctaccttgatggtgttcttttgaccattaaatgctgtcttgaaaaacatcatgtcagtgacctttgctaagaactcgacattctggcccacgatcggcttggttaccaactcaattagcagggggtaagaaaaagtagaattaacttcataaatttctttctgattttttagatcaaataaactgatcgagtgtttggtacttggaatcaacgcaacgtgctgtttgtttccatagtcagcgtaaagctgaacatttgattgagaggagtcatacacgttattaaacagtatgttcaggctggacccgttgaaaaatgtgtagttcaattgagcactgatagcggtcttgtaacgagcactaactatttgtgtcagctttgagtccccagggaatattttagcctttatctcagtagaattatcgttcgaaattacagttccttcacttgatttgatgctgctatgctcccaagtcaaaaggttggctgaggtgacccagttctgtccaattgtgttgccggcagaagcctcagtttcttcctggtcttgaatacagttgcttatctccacctccaaaacggtatcttcagagtcccaaaggtatggaaggatcgttgacaaatcaaactccagtgccctgacatcgaaagcactggtggaaactatcggtgaccatagggctggagaaatcccgccggtgtagatgataggttcgggtgacaaagatgcaattctaatgccgttaatgtaaacattcaccatacggcatgggccatgaggggccaggtaatgttgatggtccgaaaagtaatcttcaaatccatccaagatgtttgaataccaaaactcctctgctgcatttcctgatgtgaaaagtgccaatttcactcgagttgtgttgggggacaacacaggtagcgtgacttgaaattttctgtctggatagtaaatcaaaggagggcgagtaggaggagtgtctactaatgggaaaactttggaagctgcctcattggcgctgaagaactgaacatgagatcctggaataaataggtcatcatcaatgcctgcaatcttaacaggagccgtatcgttcaggaaagagtcgtaataacgtgcagttaaagttacttcaaacgaaccattcagtctaccagttagtaagttatccagctgaaccattaattcagtgccattttccttgaacaggggtacatattccgatacgtctttatgagagagggaatgcacatgcctgtttcctggttcaggagtagatgttctccacagaggcgatccatccagatagatatgagctaatctatcatattgaacaccagaaacgtaaatgtctagtcccaagacgactttattgaacttgatagcagcagggggagcaacatacgtggtgagagcaggatggccccaactgtcaccaaattcataactatccagcaacaccgattcaaagactggcacaccaaagtttggtgatggcaattccacctcaaaaacctctctatccactggaggcttttcagaaaggtttaactgccagaaagagggattccatttggcaaacacgagctgtaagaagcacactacgagaaagaagcgggcaaatcttcgaaagtcttgtgatttttttatgttacttgtccctggagggttcttcgtgtcaaaagggtattcaatcttctctttctccgaattgaactgactttcaggctcttcaccatcagtgaaaaactcggctggtggggaatctttatgagccaattggttccataaaccccattctctgcaaagtagtcctctcatactctatacttttgtgaaagcaacaaaattaaaaagacaagagtagtattgtgctgctgcaatggagagggatgggtcagcctaatctcctatcttagtattggcaatagtgtgccaaccattatgccgttatctataggttctttacagtaaaggccgggttacctcttcactttggtgtagtggacaagcctattaatgaatcgagacgtttcacgcagactcatctactaaaggaaccgcaggttcgaaacctcagtgagtgggaaattcggtggtattcgctgtcccaattcagaaaattgctcttgagagcttcctaagcgtgtaaacgctgggcggggccatcagaaatttacaggcaggatggggttcgccccttctggctgatggaaggctccgcggacagttggcccgttggccttggccaacggcgctgttaagtgcaatgcgtgaacccttcccagaagagcacccgataccgatcatcgtcttggttcattttttgccagttctaccatgagcattcccaatttaagaaaaattgtggctgatcttcggactgaagaggaagagcgtatgtattcccgaaaggcattctacaacttcattggatttgttgcgagttgtttggcctttactttgatcagtcaacgggcagctaattaagaattgcaagctggaggagatagaaaggtgaaccaaagatacgtgagcctaaagggcgccaagatagcatttcagagtgccgtaacaaataacatatagcaaacactgataaccatcgatgggagtaaacgtctcataaaatactctattagccatctatctacatctgacctccacaggcctttgaccatcttaacactaataatgaatcattctacatgtaattttatcatatacatcatacctcgtccccaatgacaactcagaattgagcgttgaaaaaataggcctttgccatctcataagcagtccagctgatagccgtggaaggaatgttgaagatgatacgaggtctgagaccacgcaaaaaggctgagtatcctgactgacggtaaagggctatagtggcatcttttattcctctggagtttcgaacaccaggatctgacgctaaccctttagtttgtagagcagtcttgatgcaatccaaaggtgttgtaactgcagctgccagagccccggaaacacccccggatatacagtgcattaaaggatcgtaattatgatttgggtttaatatggaggctgtccattcgtaaactccgaagttgatcgcagcaaaaggaatactcattaatagagttgttggataggaaacgtaaaacgtagataagccctccgatgcatacagatggcgagccatctgaggtaggttcaatttgggtacagttttatcagcttgcattctttgcttgacgacgtcaaatggagtcattagggcatcggacgcaagtgtagcgcagataccagacaaggcagcaattactgggtagttttgatctgtgatgagttgcgagttataattattagtgaaggtgttaaccaaagctgtcttggaattttcaaagactgcaaaatagacagcatgtgcgggtcctgctcccaagaccactgatgatacacctcgccagagaacccggccaccttcagttgaagcaatctttgaaacagaggcgatgattcctcgtggaagagacgaatgcttcttcatctgaactcttgttttgattgcatctatggggaacatgaccgtatgctccatgataccagcaaatgctcctgctgaaaggttggctacaagggaagagtttgctggaagagactcgtaatccacttcttctactgtttcatggctgattcttattccatgggaggtaggaggagggcttttctgttccatttcggtggtcattgaatagggaagctggtggtagtcctgaaaaaaaaatttgtcgaggaatgtaggggggggcttgggggaatgttaggggcaaggaaacctctttggtaggtggtttcgctggtcgtagacacaacagaatcgcaagttgaaattagcataggttattgagggatattcggagctatgtcttatctagggttaaagatagtagttcaggaggatccaaattgcgtattaggtggaccacgggtgttgtcaactagattgctctgagaatagttgtgagaaactgttctctgtaagggtctggaaaaaaaatcgctagaaggtgactaactctccttctagaaatacaatctactagtcccactaaacccgatgggcaatttcgtgtctactcttttctttttatctagtttagagcacagttcctatatcagttgatatcaaacctattttatgataggggttgtgtcaaactcaaggtcgacatgttccggtaccaaactcaacaccttgcctttttccagtacattccggatattgtcaactacatgttcctccatgtgcagcgaggtctcgtaagtatgagtgcccatatgtggtaacgacaccaaattgggcaactctaaaagttcttgagacactttgggttcaaattcgaaaacgtcagatcctactgcaccaatatggccagatttcaatgcttcgaaaagcgcttcctcatcaatgatagctcctctggcagtgtttacaatcacaacacctttcttcgtcttggcaatggtctctttattgagagcatggcgtgtatgcttgttcaaaggaatattaaccgagatgatatctgattccctcaataaagtgtccagatcaacgtactccgcaccatcctccaaatcgggatccaatctcttacggttgtaataggtgatcttcttgaatccgaatggcttcaaacgatcccgaatagctcttccgatgcctcccattccgtagattccaactactttcccagccgggtcatgtccgtcaggagccccagcggctttgtttccgggaacccactggcctttcagcatcaaatcgtgaccccattgaaagtttctaattgcagaaagaaggaggaagacatgtgtatccgcagtggcggcgtccacaattctaggaacgttactcaattggatccttctttcacctaatggcacggcatcaatggtgtcatagccagcgccattattgctcaccgatcgaagactcttaggtaaatactgaatcagttcagcgtccaacctaccagtaatcctggtgctagcagcagttttggcaattgccaccacgccgtcaaactttccagatttaagctcttgaatgaactcatctctgttggtggcatcggtatagaccacgtcggcgatctcttccagtttcttccaggcatcagacgcatatctgactggcccaaggttgagcacttttggcttctctgtcatggctgctataattgctggtggggggaagaagaagaatcagaagttccccaagattaataagcgagatatatatcatcaacgttgttctgggtcgtgtacgtctaatgcgcaacggttacagattcagatcacgaataaagcggttgctcgtatctattccgtaatcccatgttattcttgagtgatttttcttccacactctccacgtatatctgacatcataattaactgaagatacgacatcaaagcttatgtaatgaggacatttgaaactactctatggaatatttcgcgcaaggcaatctgatctctgtcattgaaaaaatctggaaacttcaggttaccctattgtcctcatgttcaggcaaatcccgaaattttcagtaatcagggcgtcatgttttgcaagcaggtgtttttatagctcaaaaagctctaatgccacgtatatagcaagcttgctggcagagtatgacaaaacaacgaacagatcaaagaaacctagactgaaatcacgaaacgatccaaaaccaagcttcaaaggtgcaaaggcaaagaaaccagatcgtcatataaaccaaacgggaaaggaacgtgatagagaagccctgaaagttgtgttagatgaagtccagtcaaagtataagagcaacaatgccattgttattcttccaacgggaaatcttgaagaaactcagctttctaaaacttcactaaccttgaacctcgatgagcatgggctgcaggtggttggtgaaaaaaaggactccaagggaagatctgttcccctagtgaaagtagttgaccgtcaaacagctataaaaaactacagtgactaccttcatcaacaggtgacccgcaagttcagttcctcgttcagaaaagccattaatacgtccaacgtggccaataaagatccttggaaagttatcaaagtgtcgtggaacatttctcctcaagatcttgcctctcaaaagtgtaatgagattgaacaaatgctgaacaaaggccagaacgtttacatcctcattggctctaaaggagtaataaataagtcaattgacaatccagaggacttgttcaatgagcaacacaaacgggaagtcagcttagatgacattgaggctcttcgtcgtcagaaaatagtggatactttggactcaatgttggaaactctaccgactagtagtatcggcaacgatggttcaatttcggacaaaatcatttataaaatcaaagcccagccaaagaaagatgataaggatgaaaagaagaggttgaaagaattgaaaaaacaggaaagacaggaaaaaattagacttcgtactgagaaaaagagagctgaaagtaaagcttaaacttgacatatacttaccccaccaactagactttgctgcatattttttagttggttaattccatagaatgcagtacctgtaaatagatacttccttccatcatgtacactcaaatcaagtgatcttccaaacccttggctcccttggttgccaacaccagtaataatcggctcttgaatcacttcgaaaagctctaggggagactctaacacattgttcaattctattttccaaacagctcctttccagttgtcaaaatgctgcgagctgatgtacacaatgtttgggtctgtggggtcttgagcaattgcctgtccaaactgggaatagctggatggcggcgctaaagggttcagagtcaacttctttaaaaacttgatcattggatcaattgcatacaaataaacagcaccacaaagaggacaaccgggtatagactcggaatgagccgatatcaacaaataggagatttctttgatttttggagtaatgtggataaagctagatccaaattgcccgtctcttgatggaaatcttttgttagaattgacagaaaattcagatatttggtcacgttgaattatatgtattggctcccaactcttgtaacatacaacacattgtgctgcttcaatggaggcaaaaatcaggttgctgtgaacagcaacctgtttaccaaaatgagcgtactcgttgccatgctttatattcaatggcaatgataagcgtttccattcacattgtgaaagtgacaaggatctttccgctttgttcgttcgaaatatcaagtgacgaagaagaaggccatctattatactgatgtagcctgtctggggagactcttgagaatctcctaaaaaattgaggattattagatcttcaacgttatcagagtttacatcgtacacattggtgtatatcccaaactgattatctgggccgtgcgaaccttctatcacgtttggatgatcggaatgtatagtcaaaagcaggatatttctatagtagaattgaatgtagccaaggcctggtgtggataccaccaaaatagaaagtccatgaatatgaatcgttgataaatggcttccaaatcgaggtgagtaagtcaaatgtctcctgtgcaggtccagtttcatggaattggcttcttgagacgagggatccaataattctgatatggggatgatataaacagaaccataaccttcttcaattggggctccgacagcgacacaagcaccgtttctgaagcctaggaaatttcccaatgctaaactgtatccgaagagtgagctggcgctatacggggaaacgaagatcggtgttgcaattttggagacaatgacgggggaatatgaaaactgggttggactattatctcccatgccatcactcgatgagtgtttgcggtagatatcacagattttccaaggatcaaatggtacatcagaatctaatagggtatccaatgattcaagacatctttttgacatcgagaccatgtcgattatccccccaaaatgatattccattatctgatcttgaatgataggagatactttgagaaactgttgcgatatcaatgaaggatagccatgaatggatgaatctagctcagtctgcaaagcaatagatccttgtgaaatgcaataatcgagttgaaatttggacaatgatacgttccatttttcattgatgaccctaagaatgtgcttagtcggatattggtatgagatagaagatacaaactcaaaaagtgggttttcttttcccactgcattatccgtcaagaaatgattcagtaaaaagaaatctcccgctgtatcaagaaagttgtgcgccaattccagctgcccgtcgaattccgttgctgccgctatcctcagcagaccttgagcccacgaaagagaatgccaattgatatcaaccaattggtgagagaacatgccatagatgaaggctctataattagaaatttcatcctcctccgaaaactgattagaattttccctgtaatcttctatgaaagcgcccagtaacttcggccaatgcaaatcttctgataactctgccaactgtgtaccagcacagttataaaaggcatctgggaagaaagatcccgctgccaagctattgagatcagcccccaactggttcgtagtccaataagatgctatgagatgcaccaagacgccggcactttcaacggctctaaaacaaatccaggccaacttcaccatttcaggatagcaatcaccatagaacgccttccagtacgactcttgtataagactttgttgggataagccatcccatctgataaagataaatgctatggttatcgcgaagcaagtacaggaaagaacatcaccacacccaacggtacacaaggatagaagaactccgccttttaagctttcacttccttcagttccattccttattgacaactgtctgaggacccgatcgatcctccccactgaaagtcaatggtggctggttacataatagccataactggggcgaccagtttaatcgctatactcataacattcgcatcaatactgtcacatctgcttaactatagaaagccgttccaacagagactcatcataagaatccacctgattataccgttttttgcaatatcatgttttgcgaccgtcgtgaatcctttcgtgggcctgaacatattggcccctttccgtgagatttacgaggcgtttgtgatttacaccttttttagttatcttacaacgatcctaggaggagagaggaggatcataatagcgactagtggaagagagccgatacagcaattacctcatgttccgacctggatacttcccagggtggatatttccaacccttatacgtttttgagcatcaagagaggtattcttcaatatgtttggataaaaccacttctgtttttaataacaatcatgagccaggcattaggagtctatgacgaaaatgactttagctttcatagcatatatttttggatcagcatcatgtacaatgttactgtgtccatgtcgttgtatcagttagcaatgttctggaagtgtttataccaggatctaaagcagttcaatccatggtccaaattcatgtgcgttaaacttattatttttgcttcatattggcagggtttacttctgagcctggtcaactattttttcagtattgataaccaactgactacacagatagaaaactccttgctgtgtgtggagatggtgggctttgccatactgcattggcatgctttcaactatgagcctttcaaaaaacagaatatgcccgaatgtggacggctgagtctgaaatatagtatcaaagatttcatgggcattgaagatttaatcttcgactttagacacactttcaatggagacatgtatggttataaaacttttgattctgttgagtcgatcattgcgcatcctgaatcaaagcaattttcagatagaatcctcaacaaagggatgcgctacagccgaggaagttctagaacgtattggttagaaagcagtagcttactgcgaagcgagagcaccaactcgtaccaaagtgtgcaaagtcatacttcaaacaaccgcaagcctgttaaagatgatttcgatccagaacaacttgtcaaagacgataaactatattcttatgtgaaacggcattacccatttggagaccctaattgccctgtcataacggaggaagactcttacaggtacagccgcaacttcaagcagagacgacgagatctggcttgaggctattacttctatttatgagaatgaatagacaaacaaccagtgaatgacattatggtacctatcctattaatttatacccgtttcatatacattacatcatcttctccaccactaaataaataatactataattttcttagttcccatcaattttcttttcagcaagatatttctggaagtagttactgagcgcattgagtgacctagacttgttgctcaatgttttcctcaatttttcagcgtcctgaagaatctgcttcacggattttgtatcttcattttcctttattagttggttgattccttcaatgatcttcttccttctaaaaaagaagtgcatatcttttttcattctccaatcagacccatacttagattcaagctccacaatgggaggcttgccattaaggcccttataccattcatcccaaagctcaaacaccgttctaacgtctctgcacatttcgtacttgtattctgaactggactcactatccgaggaagcagaggtaacagatggagaatggtcggaagcattcatttccattatagccagagcagcactctcttcagaagctgaagacactgataacttttgtctctttgagtgtgaaaacgaatcgtcaaaagaatccctcttgatacctcctgggctcataccaaaggccttcggtattggcaaatctgttttgcccatgttactatgacgacctattccgtccaaggatggagaggttagaggagataccctttcatgggttggaggcagcactgtattagtagcagatgcatccatcaatatagaggcagactgcttgattatgtccatggtagagagaagactttgtagcatcttatttacctccgggacatcgttcttattttcgatgcagttattagcaactgtattgacatgatccaccgcggtgttgaagagatggttgagctttgtcaactttgaagaagactctttgtacagtaattcatagtcaaccacaggcggtatagtatgtcttggggttgttgacgagttaagcctgccagcttccagcttttcgtggaagttgtctggtagtctgataggaggaaggtgaacttggtagttcgaaagactaactttacccggaaagttgtcaaccagcattgtagacgaggaggtcaagggtttgatcatggcgcaacgagctttggggaagagggacaggtatttatatggatatcacgcatcgggccacatctaagtaaaggtgcagcaaaattggcaggaaatgacggacccgcatatcctgcatactttggatgatgttctaaaacttggagaaaaatagtgctcacgtgatactgaaaattgtgtggagattacgaaaaaaagcttgctagtcaagaacgatgcggcaaatgccgggagagaaaaaaaactgctcagctgatgaaaaatgaagaagaaggtgggcgaaaaagtagatagtaaagggagcattatggactagtaaacctaatgatggtcaattccccacagtgtgagcgagttgtgaaattagtggcaacacacaaaccttaaagcaaaagtaacttttcccgatctccgagaatagcgtatttagattcgttcaggcacgaccttcgggagaaatagggcaaaaactttgtgcgaataacgggaacgggttctttttgaaaaacaacgttatcagtcgcccgcggcacccctatttttcagggcacagcttggtgagaccctaccaattcaaatgcctcaagcgcccaaccttaagcgcgacagggacccgcgtccggctccgtatcgactttcacacccccccttctggatgaagggagttggcgcgtcgggtaattacggggaagttaggatgtcagatatcaccatcattcatgaaaagtctcctgtgttgcctgattctttccagaaaacttggtgcattccaccatcccacattctccacactctccacattcttcagctcttgtacattgtgtctaggaaggcttcaataactctgtcagcaataggtccagtcttgacgctacctgcaattccgtaaagagccgccgtgtcattcttgttttcctttttgccaattttagggtcttcagcatcccgttctatctcggtcataatatttttcaaatctgaaattagctcattgctgaccttgcatgtcgggatcgtaactgcaatgtggatggcggggggtctctgtaaagtactaagatgccatccttttgcactcagtcgatcggtaatatcatagatggaatagttctcggatgtgaaggctacaacagatccgatagggtctccgattatagaaagccccttgatgctctgaatttcacttttgatcttgcgagctgtattgataatcaacttacaggagtcaatgtaaccttgttgtccgaggtgaaccatcgtagcccaacagcctaccgttagtgcacctggacgagaccctgccagcgtcgccgaaccatacaaacctcccgtccatttgctattgatgtagtactggtactttcgcatgccttcatctcggtacagaataaccgatgaccccttcggggcaaatccgtatttgtgagtatcgcaagaaatcgacgtaacaccattcagcctgaaatcaaactttggagcatcttcaaacccggctctttccatcattcccataacaaaagagcccaaacaacaatctacatgtaatggaatattgtacttcagtgccaaatcgttcagaccgtgctcaaagtcatccactattccatgagggaagttaggtgccgatcctagtagcaaaacggtgtttcggtttatgtgcttcttcacctgggccagattaactttgtatgtttcagagtctactgggatttcatgcaatttgattccgaagtaatagcttgccttgtaaacagccgcgtggatggtaataggggcaatcatttcaggttccgtgatgccacgttcatgtaaggcatacatcttggccgctaaacaggccagcaacaacgattcagaaccccctgatgttgtagtgccacaagagccttctggaccgtggaacatatccagtaccatggcgacaacttcagattccatttttcggactccaggaaacacatcaggatgcaactgattggaaatgatgtacttctcaaaggcctggctttgcaaatgaatcaaatcgcttccaccatgataaactgccccagaaatacgtccatgttcccagtcgcctcgcttgtaatcatgatctaatctatccagcagctccaaaacttgtttctccttcaatccttcaactggtagttcgttgaacactggaaatttgccatcctgaccagtcaattcatcttcgatggatgctcttaccttgctgacttctttgtcgatcttacgcttgacgaaactaatactcataaaaaaggacaccgacctcaaaatgagactatcaatgattcctgtaatgcctttgtctttgaccaatctccacaagcgctttagatagtaattgactactagcacaaacacaatgtcctggacaatctgcagaccatttcggttgcttcggtattcgtcaagttggtgtaaacattcaaagtacaaactttcgataagcagaaccaattctggccacgactcgggaaccagtatatcgaagctgaatctttccgaaaacatcctacaacaagtgcaaaaaagaataccgccaacagccaaagttaactcaagacgaaatgagtctagaatttcacttcctatataaaatgtatctcaaagatgtatgtgcttatgtaataatggaggcgatgacctctcctctctgtgcgtttttatagagttttcaagtttggcgtagcagaccggctcattcgggtgcttcggctcacataattcggtaaagtgctatctttttgacgaagtatgctctctagcttctcaatgtatgccgtgttaaactcagtttctcgtgtcaatcggtcaacttgttcctgtagctttctcttttctgcttctctagctgcgtcaaccagctctaaaatcggtctgtcgtgtttttcctttaactctttttgacttttctctaacgctgctacttggaagctttgttctgaggcaatggtcgatttctcctggtattgaagcctcaactcttcattggacttttccaactgttttagttcctcttccaaatctttcagctcctgtttgaccttgccgatatccttctgttctacgctctctcctgcgatgactctcttcatcgtatctaattgttcctgtagttcttcggtagattcttgccattgtttggcttcttgctccgttctaattgctcgcctttcagcagcttcagctttattctccaagtccttgagcaacttgtaacgttccccaatatctatgttactttgttcaatctcagcttgtcgcactgtctctttcaagttgatctcatctattttcttttgagcttcttcaatcaaattcaacgctcggtcattggtaaaccgcactagggcagccaatgtttctgcatagttttgataagtaagatgtttgggaatcgacggtatactatttgcatccccagctgatttcgatccatacacttgaagatgctccacaggttctaagctcttgagtaattgttcactcgaggatgccgatctcagtttggggatcttcaatggcaaagggaactgagtctgtaagggagaatgaaaccacggttgtagcttctttaaatcgttgaacatctcatcggcgtcaaattcgtcatttcgacagaataacatgtcgagaacggcctgtttagaattatgaacattgctggctaaaatcgcatgctccacagagttaacagtcactaatttgaatactgggatcagattgttgactgtatcactgggtagagtattaatcgtcctgacctccatgatgtagtcagactttatatccaaatacggatctaacgagatgatcatatccagattagcattttctgggaacctaaaatttttcagttgattggaagttattaaatgaaagttcaccgggtagtccttattcaattgtgcaagcagaggattatttttcgaaatacgaggctcgtaatcgtctttgaggccctttttcttgttgttttttttcttattattcgacgcagaatacgtaggagtgctgctatcgtcagacctattattactgaactgaatggtttgatggtaatgatgtctatgttgaggtcggttcacattttcgtgagactttacaaattggtcataaagcgatcctcctgaatatcggtggtaattgatctgtttaccaagcattgtgccctctactagatccaattccttggattctctggagacaataacaatatgtttctcttggtcctgcaaaagaaagattatttgatccagggcctgaaattttcctgacgttgcaactagtctctcatgaggttccatcaatattagactttttggaatatagtgctgaaccagtaaattggggtggttgtttacaagttgaagattgtcctccagcagctctaataactcagcgctggacaggttttccattgtcaagtcaccttccgcaccgctattaggttcttgttttactcctagaatcaagctttccaaatgagatctgtgtagccttattacctgttcgaccagctccctttgctcaatcgaagtcggtactaataaatagtacagctcgtcaggattcctaacattggggacatactgacgggaataatctcccatggagacatctttagcgacaaaggaatcctggtcttcttcaccgcctaataatcttgtgatatccatcaggcctcagagtttcgttggtgattagtagagtagaacggagaaagcaccccccaagaaatatttcacccgaaagcaggggctagagatttgattacgcgaacgcattctaacagcatcttggactatctatctcaaattaactactattctgaaccactaatctagagagatgagtaaagaatgtgttcaacgacacatcgtcagattggacaattgcttcgtgagcagaggccgtgtatcctgccaaagccgatccggtggtctcggtgtcgttctccgaaggattaagcttggagtacaggaatctcgcttgagatttaccctcgtctgtggtgacatacttcggtagaggaaatctgtcactgattagagaggcggcttcttcctgggccttttctatcatcgcatagacacctgggaactcttctcttggatagttggcatctctccatgctgctgcaacgctaccataatatatgacaatgaagaagaaagcatcgagtaacaagacacagtcctgtttcaacgaagcagaatctaaaagaaccgggacaggctcagatccgtctgcagaaaactgggtcaatgtaggttggatcataaccaaagaatcacgaatatcggttcgtaaaatggtgtgatgatagaatgcagtttcatccggcgaacagttgaaaacctgcaagaattgagatcttctcaagtggtatataaactgtgggagcaacgaaaacttggtggacaatctgaaagttccagcatcatttttgctgtagtctccaaacacagtacagagtttgaccaatgacttgtcaatccagcgcaataagtccgagtactcattcccattttcaatcttgttcacaatcaatcttgcgtacaggacagctgcagcctcctgatcaaaggaattagccaatgggacagtgttagaggtacctcgcttcagagtggtaacacgagtacgcatttgaccgtttgtgtgtctatatgtagtcgtaaactgaatgcatacctcgtttacagaagaagaacgctgatctgaggtacctacagtcatcatatcaaaaaagattgcataggtgttctttggagtcagagaacataatctccatttgtttgtaagaccttcgccaattggagtgtcagatatgttgtttccgttttgcttcattgaaacagcatgtccaatcaccccagaaacttttaatcggttagatgtgagaacatctaatataccgtcagagtaggtcattggatagccttcctcatccttgttgaagcatgcaaaaaaggagtttttaagaatggatgtttggaaggagtcggtcactacgagaacaccgcctgtaaggttggctaaacttctcatttcgtaaattccaacttgatcgtaacaacctgcaaatatatccacagagtaagtggtagaagaagaggggtcagcaaacttgtctttcaaatcctttctgttgttacttcctttcacagctagtctattgtagaattgataagatttcttataatgcgaggcagttcccttatccatatcattatgagatctaatgggttccttcaattctggtccaacaatggttcctggccctaaagtacaagggcctgcactaaagagagtaatcttacaagcacaatcggcgtatgaaccttcggccaatgaagtggctaccgacagagcagcaccagttactctagttggtctttggccctgtggataggtccacttggatacttccaagcgctcaatggctcttattatttggaactcagcatctttttcagcgactggtaagaagaacctagtcacagcgttatatccagggttttgcaactgtttggcccaaggaatggtaccggatttttcaattcccaactgcctttggatttcaatggaggtgtactctttggttccgttgaacacgtacttcttcaaacaagttcgtgtactaagatcgtggacgttgacgactgagtcgaaagttaccagtccaattagggctcctggagggtgcaacggcagcgatgcaatcaaagtttccttcatggagtctagctcactctgttcctggcataagtcaacaacgtatatataggcaggaggagggtgtggttgcgcccttgaaagaatatactcaatagtagaagactgggggttcaactccaaaggcaagttctctgtagaaatttcagtataattgatcggaagagtgtttctggatgaacagactggacaagaccacacttttgcggtaagatctatcatggcgtaagggttcaaagctgcatgacattgccgacacaaaacgggatcgtactgagcaactggtagataatctctttcgttcaatggagtgtacagacaaccaagaggcatggaaatattttcggactcaattttggtcactgggaaagaattccagttgaatcggacaccatctatctcttcaatctcatagatgtcagccatggtagagacgaataaacaatagacagaagcggcgtcaaaaaaggggaagcaaaaacaaagaataagcccacttaactaacaataggtaggcaatgcagttatatgattggtgcgaattggtctgtaggaaggtgattgatttacaatccaggaatctctcaaggaacttgacacgtttggtgaaccttgtgcggtggtgtatttcttgtcgatttttcaaatctcgaagggtatgtagtggtgcttggatgtaatattctggcacctcgcaaaagcgagtactatttctcaaatcagtaggtgaaatgttatttccggatgtggaattgatctcggagaggaggagagattaagggtgcatgagtggcttattgctacttaccaaaaataacctctgtagcatcaactgaaacgacaaaaaaaagcaaccagtcagtcaagttctaactcagctagctgtccatcagtggaagcgtttagacagccttcgttgaaagttttgccccacctccctcctttaaacccattccctgcacccccccccccccccggacttaactttttttcttttgccaagaacagtgctaggttcttttccgaaacgggcttagttcatggaacaccccattcaccccgctcgcgaaaaaacactattactaatgaagcattactcactaaagttgttcttccgcttactcttctatcatttttttggttaaacttcgcctcccacaacttgtaagagaaaagatttcgtttggaacggagcatcgatcaggtttttagaacgagacttcaagctttcaacaggaaaacagcagcccggtgaaatagacactacccactgaatttgccccccttattataccccttcaaatctgtatacttactttcctgtatagtggcaaattttatacaaacatcaaatccggtggcaacaatcacacaaacagcaatgagtgacgtggtaaacaagagagcggcaacgtccagcacgcagaccaataagagacaggaactcagctcggcgctgacaaaacctggaaggaaaccagtgcagacggaacccaaggacaaaagaactgcccagaatagagctgctcaacgggctttccgtgagcggaaagagaagaagatgaaagaattagaaaccaaggttgaagagctagagagacaaaaatctcagctgaatactgaaagcgaatttctgcgatcccaggtggaaacattaattcatgaactctcaaaatataggggagaaacagatgtactaagcctactgccgacaagtataccgcaggagagtaaaaaaatggtgagaactcctagtagcaatacaacaaactccagttctgtcggggttactccgtcttcttccactctgcgttcgtcatctagtagtggagtatatgaatttccctggaagctttctaatagtcaaaatccaagtggaagcaacagcccattggatctcactaaggcaggccaactaccgtcaccaacttctatcaatcagaatcctgggttgacggccgaatcggtgaagagctcctcggtttcaagtgagtcaccaaactccaatatagaagattttttgaatagcaggaatagcaattttgacaaccgatttgatgagtctgtggatggcttttgttccaacttaggccaagcttgcggtaacaaagacattcctcttccaaaagagacttcatccataaggaaccctggcgtgatagatagtttgtcgaatttcaactcgaattccgatatacaaactcttttctctcccaactccttacaaaatgacccgctggccgagtttgaccctacccctattgaccaaaatcttgtgtttgggttaaacgctcctgagacgaatttggatggtctttttggtgactttaataaataccacacggatccccttgcgtctcttgtcactgaagaatctatctttgacccattgagagcgacatccaactctgtatcccattcaaagccgaaccctatcacaactacgagtttgcataatttggaagccaagcacaaggtaccagaggctgacgaagattgcaacgataatttggacaacatggtggtacctaacagagaaggctctctactcaagtgttcagagatatgggagagaattacgactcaccccagatattcggaaatcgacattgatgggctctgtatggaactgaaacacaaagccaaatgtagtgaaagtggtgttgtggtagatgatgctgatgttgattcacttttacagagggctgctctcaagtatcccataaagactgagccagatgttgtcgatttttccatgtttaaatagtattttttctttttttttaagaattttctttatgctttatatttcaggaagatagttagccctagtttctcttaattaatcttattctgctgacatgatcaacatagtcatggaatacttttaataactttcccaacagagagttttcctggaagaagtctttgccgttgatgaaaggaagaacgatggtcagtctgccaccattactatctcccttgatcgatgaattagattccagctctgaatgatgaatcttttgcagtgaaatttcgtttgatatcagattcggaattattatggagcgctttatgacggccaccaacacagcaataattacggcgtcaatcgcaacatgcttaataactgtcttgattagcttcaacagtaacgaaatagttcctagcagaactttagatacaagtggctggtttcttcttgcacgaaatctgcggttgctggaggacgacgagatatcgttgacaaaatcatcatgagttagatctgaacctctcttggagtaaagagggtctgaagctgaagattgcaagcgcctattagcaagtaattgcaagtcgtggttgagtttgttgatggaattgttgatatcattctgccatttgatgaagtcaacatttcttggggtcacagaaccttggtatcttcgagatgataatggcggagtgggattcaaattactgtaataattggaaagactgtttagtctctccgctgttgaagcgttgatgaatctcgaagagttatgtctctgaaaacttggattatacatggggtccatacctgaggaggtaatagggtcgtcaacaacactgatatctctgctcaacaattgagcatggttctgtagtaactgtgcagggccggcattcgattcagaatcggacgagtcattgggagaaacatcgcttatctggttccataaatattctaactcggacagcaattctctagcctccgtggtgtcggatgcaaattgtttcattgtatcaatcaaatagctgatatattgacgcttagcttcagtctttgacgtaccctgctctgatctccaagcgtcccacttccttttggcagcctctgcctctggagagtcgcccaatggtcgttccatgacccctgccacgtcaccttcagtggcttgtttgtagagcccgtacaattttaccctgttttcaattggcggtctaggaagccctccataccctgttcttgaggaaagtgtgcgaattgttccaattgcttttacgaagactcggtctatggattcagacatgatttgttaccttggacaaactgtgtttttgagacaattgaactaaaattgatagcaaatgaagggacaatatattactgtggggtaagacaggtggacaacgaacaaagttaccaatcaccaaataaatcaacgaaaagaactgacggattccaaatgtaagattttcgtttgcagccgttaaaaagtttctgcttttcctgggaagaagtcagtgcttttgacgtattcaaaagcaagtagttttgcgggaactgcctgatccctctgcaggttgggcataacaagttctccagataggctatttgtggtgtaaagattttctactggagtaatgagtgctacgttgccatctgacatctgaaaaaattaaaaaacgctatatacaatagtggctatgtctagttgactatgattaagaaaagaacttcttcaaatccgacaaccagctgaggtaagcctcattctccttgactgtagacagagcaacgatgaaatcacctagctgggtgtcaatgccacgggataggaggtatccttggacagcctcttgcaactcatcagccaggttgttaaaaggaggtccagagtatttgagttgtctcaagttgttagcctcagcagtttcagtgatggcaagttcgccgtccttgaagtaggtgattccgttcacggaaaattcattggtctgagaagacagcaataggtcgacgccaacagcagagttgtctgccttcttagttataacagcgttaacgctaacaatgccgcccaaatccaacagctcttcgggatcctgatcatcgatctcagggtccatttggttggccaactcttgttcattggtgacttgagcaacatcaaaatacactctgatcacctctgagtcagtctctttgactaattgtttgagaatgctctctccaacgtcggctaactggaatccggactccttcaagtagttctggtggtattcttcaagaccaaaactgtcgtcttgctcaaattctaattcactcttaataatatttgacaccttctccttgctctcgttgaagacaattctattggcatggaaagaacgagccaatagggtggcaaaagctactcgcttagaaagcccaaacaattgcttctggtaagatctgttcactacccttaaagagcgaccaactaatctgatagacatgataaaacgattcaatagggttgggagaggaaacaaaaactgtgaacaatttttcctggcagaaaataacacttcgcgaagataatcggtctagaagataaattcgtttgtggggaccttcaagtatccctcacaataatctacaatgatgttgatgagtttctaaagtaccagaacgaccactactgaaagtcaaagctgtatttaagtcttctgaggttatcaaaagtggaagcttagtggacagaattcatagtggttgcaactagatttttgctctaatagaacccaattgtaagaacagcaagatgagttcacttttcgatggatatttgatactgacttggacttcagtaattctcacgatgaaaatgagccggggaaatatggttgaaggtaaactgaacttaattacttactatacagttcatgagaacccttaggggtctcccaaagggaaaggaaatagcagagctatgctgctggtcaaataaaacgttgagaaagaaaggacaaaaaataaaggattagatcataaacgcatacgcatccattcttgaacgaattcggctgatcgcttgtaccgacgttcggagtatttttcaaagattgtacggtgatgtctaagagggtgtcgacacatttgcaccatcatgtcggccaatggtgtcagttgctcctctgtgtagcccgagtaaaatatatgagcatcagtccatgaacctctgttcagtaatcgacgtgcaaggtaatgagcacccgcggctaaccaactaggtggggaggcgaccagtttcgaatccatgattgtaatttccaaaaaatacttagccagagtacgcgtatcaaaatcgtaatcatcagcctttgaagttcttctgaggaatgacattggtcctggccagcccatttcgaattcaagaatatcaatcatgaatttttcagctcttaacaaatcgtcaatagaataggcgttgttgataagagatgcaacttcctggattgaagggcagttgatctcctcgtatttggcagcaatgaatagggccacaagaccgactagttggaaccttgaggcggaaacagttcgtttacttaaaaaacggtctatgtaattgaccgtcaagaaaagtgtttccggcagcaagttgaaacgtgagtgtacctgaaccagccagtcgacaagagtccttctcatgtgccattcgagttcgttttggctatccatgtaacgagggttgggtgaaagacgagcctccaattgtcgcatgtatctgaagatgtctggcgcgtattcggcaaccatggtaacatcataagtgtcctcatcatcctcatcggggctatccctttggaatttggaattcacgtaggttagttcgtggtggatacgggagtcccacactgggagtaggggaaccacagacccagagttagctgttggtgctgttgtggtggtatccccagtcgtggaggactgcaaagtatgcctgtgctgtgtaaaactccttatagactcttcgacctctgagtcagtggaatgcaaagattggggctgttggtctgagtccaagacatcttggtccaactcgccaaagtcgtcctcgagttcttcgaattcaatgctgtcttcggtatcgtcactgtcatggtcctgcgactgtgactctttcggatgaggctctacatatacggggattttgttttcattgtttttcagcctattgttttccaccaggattgggcgattttgctcagtgggcaactggcccagcgccagacggggctgggactgggaattggccgagtctgttgccccttggttcttagaacgatactgaggtctgataacatggttgttttcctctccgtatgtggatctcggtggtgcaatgtgtttggacatgaagatcagtgcctactatctgtttatgtgaacaagctgggtgtttggtatctagcgagtgaatgtcaagttgtatcacgtaggaattgctggcaatgggacgggcaggctctcagttaattcgaaagattgtgggagtgtcagattcactccttcttgctggtgtatggggatgttactgtgttttgattagaggaatctttgaatgagggaggaaaaaaagataaacactacacaaaagagaaagcgagaaattagtggtcgtgtatacccttcgatctgtggaatattttttctttttcccccactagctcgctccttcaacatctgccgtatccagatctgaaagtcctggcaaaccataaaaatgaatttgatatatctggtaaacctagatattccggaaccggaagaattgggtggaccaagcgaatactagtataaagtaacatttgtcaaattcaataatgaacgagatatcaaatccagccttgttcatcgagaggcttctgatggctactatgaacactacttcgtagtaagaggtaaaaaaaatgtcgttctgaaatctaaaaatgtgagtttctgcagagaaaaagaaattggtggaatagaaaatatatacaaatatgtcaagatgtgtgaagagaaaactataaataatgaagttctagaactggtgaatcctcctgaaaattatcagaaagataacaaaataagggtgtatactgaaatagaaatcgaaaagataatgtctgaatacgtgacatatatagacatagaacgtgggggtgacgcgtatttaccagaattagatcaagatgcacaattccatttacgtatccattttagagatgtccgcatatactcaaaatgtgaaggaactggctggagcatgcagcttgattggtctgaaaatttgataaaagagctttatgagaacaaggactttgaccggagtctatatgaaaaatttgagtatgcacataaaagttaagaaggtgtgtttaacgttacaggtgagaaaagagatacctgatatagaattcttttactgtcctattatgcaactctgaatcggaagaataatcacattatttcagtcataaagtgaaaatggtacagttccgaaatctattatgagactccacagagagtagacttaatttgttagataatttccaagagtatgacggttaaagatttcagagggtgtgaggacaaattacgtttgcaccattctcctaaacccatcaacatgaagccaaatggagactctataatcaagagatgagaagatcatagactttgggatatacttcttattctaatctagatgaaagtaagtagaatgaactcatgttgaaattctcaaaactcagcggtattaaagaatggcgaactgtttacgacttttcgttatccaaacgaatgaaacacagttcattcttcccaaactgtaagcgtatgccctcaactgatggttcaacgagctgtcctaagatatcttgagctcagtgcttaatatatcttcccttcgccaggctcaagcgcgcctgcccgtttaaggaggcgatgagttacgttctcaattttttctcctccttgcttcaagatctgatattccatgtcttctgctaatatttgggtggcagcctcggatggagagctggccaaggtgcaaaactgggttgagaagcacggtttgtccccaaacgaaaaagatcctaacgggtacactccaatacacgctgcagcagcatatggccataaagagttgataaggtatctgatagagaaaggagctgatatcaacatacaggatcaagatggagacacccctttacaccacgttgaatcacttgaaatagcccaattgttagttgaagagttcaaggccgatcctcgaataactaattctgatggcttaaccccattgcagttcattcaagaagaggatgaattccccgaggtgattgagtatctacaatcattggcattcgatggagctataaaaaatgcaaatgctgctcagacaccgtctctactggattcgttgccagtcccagggacagtaggtgaccacgatattagatacacccttcaatccgcagattctatagacgatgacgaagagagtcaaaaacgtcgtgcagaaatagagaagattatgggcggagataatccggaggagggcttgcaagcttacgtcttgaatgcagttcaagagcatgtcaagaacctgcaatcagaagaactctcgaacgatacactaccagagaagaagagaaggaagtgatttggtaaattcagagcatgcagatcttctcgtacttgtactatattaaaacgtataatcaaccataggtttactacccagccagtcccatcctactacttctcatgatttatcacgtgatacatcttctcgttcttccacgtactaacaacataacagtctggccaaacactcctttctactcaagatctctggacatcgcagctacgatgatgaaaccatacaccttagatacaggttacccagtgtatggcgcaaagttcataacgaaacgtactctcctcaccgctggtggtggaggtgagggaaacaacgggatccccaataaactgagtggattcaggattgactttacgaaagtgaaagccgtgcagaagttcagagaattgactttgtctgccaatgaagactgccctatgagtcttgatgcagccaacaatgtcattctcctcggagtcaatgagaacacctcatccattaaacagggaaagaataatcatctgcgaaagtttggttatattaaccaccatctgaaatatctggacaaacagcaattgtccaatagcagagataatagagattaccaaaagttcactcatttgtcatctgatgcttcagttgcttgtattgccacctcaaaggttcctaccactatttatgtggttgatcctcaaaccctggaaaagaaatttgacttggaaactggggttgacgttaaagatatgcatatttcacctgatggtaaaattgtatgttatgtttgtgctaactcccttcatggatattcgactgtgactgccaagttgcttttcaaggacgattcgttcaagaaccatactctgatgaaagtgaagtttttagaccagcatcatttgctgattgttggcagccaaaagcaaggcatcagcctaattcattattcactagctaaaaattctattgtcaattcaagagtcatttccaagaaactcaaaggtgtaacttccctggatactaggaatggcgtcattgctttaagtggaaacgacaactccctgcttcttatcaaagtttccaacttgaaacccattaagcagttcaataagatccacaagttttcaattacttcttgttgtttcaacaagaccggagaccttttggctactgtatctgctgccaacaccgttagtgtgatggaaatacccaaaggattggcaaccaagaagtcactacccagaaaaatatttaactacttcattttgactgtattcatggcaattcttgctattgttttacaatggtctatagagaatggacatttgcaacatgcctggcagaagcttttgaacggggatgtcattgattccagcagatactttaaggtagaaagcattcctgatgaagaactttctgctagtttattggaatcttcctattctggtctctcctccgagaccaagtcagtaactgatgctatctccgcttcggtgccaattattgaaactacagtagacaccactactacttcgaactcggtccgtcgaactattcctgaaggatattctactgctaaggagttccagcctgataaaataaagctttataagtcaagtttggactctgatccctcagccgattcaactggctctttcactgtttcaatcacagagactcagagttcatctataaagcctcaaaagtctaagaagaccaagaagcttaagaagaaaacttcatcaactgcaactccaggatcttctactgcactagttgaaactttaattgtgtccacttctcctcagtctgttgacacgtcactcagcgtaacttcaccggtggcatcttctactgctcaagacagttacttgactagtagtgcccattccgctttgactacaaaaggagcaaaaaaattgaaaaagaagaggaagataaagacaaaaacggtaaaaacaacaaaaactaccgaaacggagacggaaacagaaacaatagttcaagatgacttggccgatatcacaatatctagcgatattgtttctgacatttcctccgaagttagtaattctgaaacggtagtacaagagggtttgccaacggaagttatcgagtcacttttaaataaagacccaactgtggatgagcctatagctgaagagtctgctatcattgatttaccccttgggaaaccagtgacggaaaaactgactttggatacgcaagaggccatcgaatcgtcagttgacgaaccagccatcggaattgacatcgaggatgctatagtggccgacgagaaggaagaacctcttaccgctgatgatgcagtactcgatggtgaagaaagagaaattgaggatcctgatgaaattccctcggaagttcttacggatgtagctgactcacctgaggaatatcaagatgacattaatattaataacagccaagaagctacgagcacacacgattcaaacgtttcagaggaaacagccgcgcccgtcgaagaaacccaggaaagtgtgggcactgatgatcaggcagaacctgagaagtttgacgaggaagaaaagaccgaaaacgaacaccagtacgaaaaggatgaccactcagaattggctgaagaaacacaagaatctcacgatgaccaggttgatgaagtagaagaggtgcttgaggaagtaaaagacttcctaggggagactaaagacgttcttgaggaagccaagtttgtacttgaagaagctcaggaaggtgctgaagtgtctgacaaaaccgaattgacagagcaggatgagacggaaaagtttatagagtcatctgatgcgctcagaagctccgttgggactgtagaggctactgagcagaccacagctacatctgttgatccaaacactgagattgacacgaaaacgacttcagaagcagttattgaatcgaacactccagttgaaaacgaggagtcaacagtcgaagatcgtgaaataaactcgagcattgatgaaatagctgaaaagtccatcagccaagaggagattgtttcaaagttggaagactcgtcctcagaaaacaacgagggtgagcgtgaggaagaagaaattgaagaatccgaagatgagaaagctggagacattgaagaagaagaagaagagtacgaggatgatgatgatgaatacgaaaacgtaggcacagaggaagaaaaagacgaagaagaggtgcaaggagaccatgaagagcaggaagacgaggaggaggtagatgatgaagaagaggaagatgatgatgaagacgaggaagacgaagatgaagacgaagatgaagagggagaaaatatcaatcatgatgaactttaaataatccgtcatataactttccatctcaattgaagttatactatgtaaatggttatgaagccctgtactcctgttctctgctgccaaaccacctctatcagaaagcgagaagacatattgtgtcctaagtaaactcgacaaccaacaagactagactgtaaaatgaagccagtagtcacggtaagttgacatttctgctcctaaagaggcttcccaagtatactgaccgaattagcccgcaaaagcctggttttgtaccgttatatcagcatttggagttgtcatactgggggttattggaacacttttcaaacacaatcatgagactgtcatgggatccataaatgatcctgaagatggtgcagcgtaagtataggatttttgagggcttgaagccaccatgagagaaattattctctaggaggactgatgagtactaacattcgttctagtgttgccaaaactgtttacggagcagcattgttgtatttagcattctttgtgttttgcggagcccaattgttctttataagcagacaaccatcaattcaattatagaggagttggccgtgaggaaattgagtaaaaataaaatcaagactttagaatggggagtgtggtataattattcattgattggatattttaactaaattgaattaatccaaagttctcactttacgatccaatgtagctgttgaagatgttgtttgaccttgtcatcttctagcattcagtgttccgacgtttcgttttcgttacctaatcttttattttctcgcattctttaagcttatcgcataatccttgccattatggataacataaaccaactcctaggccgattggaattggaacatctgaagaagaatggtgcttcggttgaaacaaaggctgaggaaaaagctgtgagagaggagaaaccaccacccgtaaaggtctatgtggcatcaaaactatcgcctgatcacagctatttcaaatctgtagcatcaagtgacgctccttggaagaagctgaacaggtctgaagaggctaaccaggcagttagaatcaagcctccctctgatctcaaagcgcaaaccgacagaagtgtctatagtagacacgaaaggtggggtcaatacgataaaagacctgcaaagtcagacaaaggcgaatcaaagacagtggaggataaacattctctcgccaaagaatttttactagcactccagaaagaccacgagtctgatgcgaaaaatcccatacacgatgaagatagagttgtggaaggcttgaatgtgacactactggatcatcaggtgagaggattaaggtttttccagaaaagagagtcaaacaccgatgcccaaagaggcggaatgttgtgtgacgatatgggactgggaaaaactattcaaatgatttctctaattcttgcaaatcgtcccacgaaggaatttcgcaagaagagcaagaactcccctgttacactagttgtttgtccacttgccgtggcaagccaatggtgtaaagaaatacaaacaaaagctccctcactaaaaacttatattttccatggctcagataaagccacagagtacaaagaactgctaaaatttgatgttgttgtgacgacttataatgtcgtactttgggacttgaaaaagaaatcaaaggccatcttgactgcaggaaactggtggagaattatccttgatgaagctcacaccataaaaaacttcaattctatgactgccaaatcatgcatcgagctgaaatctagtcagaaatggtgtctaaccggaactccgatacagaataatctggaagagataagggcgtacctcttgtttttaaagatgggcaagtacgctgacccaaacaaatggagtcaagacatagcaaaatcgatacataggggacacgccgatgaggccttggatttattgaaacaagattttgctcctttctttttaagaagatccaaagctattctccaacagtccgcgtctggattcaaattgcctccgaaaataattcactccgaattagtcgaattcgatcctaaggagaaaattctatatagcatgatggagagaagaatgaggagtgtcttacttcctgaagaggacaatgaactggaaagtcaagtctccctgaaagttgatgtttcttcaataagtggttatttaggtgcattggtatgtctcctgagactaagacaaatatgttgtcactggaacttgatttatgaattcaaggaggaagaattagaaagcgaatacaccccaaatgctttagaaaattcagataagaaagttgagaactcggttgaagacctcaatgatatgatgaaggaacttgaggttacagaaaagaagtgtctgatatgccgctctcaattgtggtccgacgacgtgaagtattgttcgcaatgcaaatcgttaagcgaacagcaaactcccccccttgaacgcagtgccaaaagtgagcggcttctggaaatattaaaacgagacccggcaagaaagacgatcatattttcacaattcaccaagttgcttgcaactcttaagcctttcttgacaaaaaatggcttcaaatgtgttctgtatgagggaaccatgactcgagcaatgcgtgacacaacattaaaagaattcaacgaaaatccagaaacgacggtccttttgtgctctctcaaatgcggtgctattggcttgaacttaaccatagctaatcgtgttgtgatttacgatccatggtggaaccctcaggttgaagatcaagccatagatagggtgtaccgctttggtcaaacaaaagaggttgacgtgtatcgtttgattatcaaggactctgttgaagaaaatattgtaaggcttcaagagaaaaaacgacaagttgcggaggctgtagtggatattcatggcaaaaagaaagtttcgctgaatagaggactaacacgaaaagaactatttcagttgtttggagtgaagtttggccaatcctattgaatttggtcaattaatttctgtgaagattcaaacctttgaagcaaagacttatctgcaactagttttgagtcccctaataatttaaatactgaaccaacttccttgaaaaactcaaaagcttcaacaacttgagcttttggtgactctgaaacaggagaaaaggtttgttcaataaaagcattagctttttccactgcttctgtccccttttcagggccttcctccttcgcatttatataggttgtcaaaaaggtcagagtagcaacgccaagaagagtgttgggaacagaagttctaaagggtatttgtttcacaatttgtctccaataatcagtatcattcagtctaactgagctttccaattctgtggccgataagaatagagcaatcaaagacgaattgagtgtctcggagacaatagtattaattttcgaaattgtggatctgaagtttaaaacagatcgggagacctttgagttgtaattgatgggtcttgttttcagcttcaataatccagaaatcttagaaatcagagtaatcgattttctttcgtcggaagtcactttggagtcactcggttccaccaagtccctttcagtgattttgcctaacttgaacaacaccagaagcaaaaacaactcctttggatgctttgattgctgaaagaggggagataccaataattcaccccattttgtcaaggcaaatgagtagtcaacaaatccaagtattgttagagcacgtaataaacctgtgcttacaatatctattggctgagagatcttctgtgaatcattgggatagtctgtaatcacactgtcagtaacaaatttgctactgaaattttggaagaaaccatccaatgtaaaaacagttccattggcctggttcgtcttcacaataatagatcgaatcttactataaatcgtaggctggattctttgattcaaagtcagctccctaactggctgataaactgcggtcaattgtaatcgtttaacttgatagtatctgttcaaaaatgatgttagaacatttaaaacttttcctttcaattctatggaatcatcaccgattgtaatcttttcatacaattgggttacctgggcatctagtggtaatctttcaagataatggtcgtatattattgattctaagagttcaaaattaatcaaaccaagggagatgtaaaaatacagttcatttgatagtcgttggccaatgacatcatgcaaatcattaggaatctgcaaatcctggtcttttggatacaacggggtgttgacggaactaggggttgattgggacgaactattagcactctgggcaatattgggaggttttgaagaggaggagtgggaaacttgaaacaattctgagttcaatggcccaacgctcccgtcttctttcaatactggaacatatttcaatagtgctaatcctctttgaaatttctctaatgatgccggatcttgtagcaatgaattgatgatcgaacctccattattgacataatcatgtaacgagggaaaagaggccgataggaagccaggtaaccgttctggttggaactcatttcctaacgcaaacgatatgttctttaattgttcgaaagaaagattcagtcttgagagaatattcgttttatctagcgatttgaactctctattctgaaattcaaatcccagaatgaacttttgagtaggattcaacagtaaatagtctgtagaagaatacaccacatctaccatttgcttactttccaagtaatgcagttggacgacagcagaataaggagccaccagatagtcgatgttattctcgataaagaaggtgatcaggtctccataaagaggccgtatagggatacttgaccatggttctctaaaagaataaccgccatctctggaatacgttctgtcgtcccagacttttcggtggtatatctctgaggagttaagttctttaccatttagtaatttttcgtattgtgacgtgcttttcagacctggaaatacaaacaatggtctaatgtttagttcttggaacattttaagatcggtatcgatgtagtttaacagtgtcaagggaacgccactaattgcatcataattaagctccttcttgaagctcaagagacgagaaatatagtgctcaacgtcaattccaatagtggcattcttcaacacatcaaacggatatgtgttgaccgagtgattatcaaaaagatgagattctagggtgttaataggcatcttgtgttggggatgtttgatgaattatgtttccccgaagcatttcaattgcatataggaggggcctccgcgcgagcagcccaccccggtccaaagcgtctctacctgggcagaaatttttcattcattcccgcctactgggtttcaccctcgcgcggttaaagaacacgttgaacagttccagtccactctctttctttctgctatcccaactcttcaccaatgaagcttcttcacagcattttctggctcacagccatcatccagctatcattggcattgacatacaagcaattacaggaaaattatttgaaaggagccaatatcctcaaaattgacaacaaaaattacaaactcatagaggaggctagggaggactttgagctcgttctcttcatcactgctaacggtgcagacgtgaattgtaggctgtgcaaagagttccaaactcctttcgaaatcctcgccaactcctacgctaccaataaagcccattattcagaggaagagatcggtaaaccagtggtatttgctataagtgatttcacttactccagaaagttcttcgaagctttgaaactacaaaacgttccaaagatcttccactacgctagcactgaaaaggcatctagtgcactgaatgtcgatgatgaatacgatttcactgccgcagatcttattacccacttacgtaactggatcacagcaaaaactaaggttgaccccaagttgttggaaatccatatccctcccaattacaacgcaattgccactaatttcatggtggcattgattattctaatagtcatctacaaaaagtacgaattgatcctgactttcttaggaaacaagaatctgtggcaaggtctttcgatggtgacaattgttgcattcattgcagggcacatgttcaacacaattagaaacacccaatatatcatggtgactcagggcggctctccagtatatatccagcctggtcaccaacaacaattaggggttgaaactcaaatcgttgggctaatttacggatcattatttgccctttccgttttgctatataaagctggagcaagcaaagaaggatcatccggctggctatctattctgataagcgttttagtatttttattgtacagtggattgataggagtgttccacctaaagaacatgggctatccatatagcttgatacatctattttagaatagtcaatatagagagtttttcagtaagcttttttcattttttatagcttgctttcaatggactcaactcttctctctattgtctccgtcatttgattgatctttattatgcgaagtttgagtactttgattctctctttgaatgtatccaacaaatatctgtatgaattgggatcgttagacctggtattgctttcaatggtggcatcaacgttgtcataaaccctctgaatattccgtagcagttggagaagcattatctgcgattcgtataatgtctgtagtttattatttaaagcttccaatggctgttccagtaaggcctgaatggttagttcaattgggtgaacaaactgagaactcgaatgctcatctgggagaatttccaaagacgattgggagggtgttattttgagttttgagacgctcttgaaattgaaattgggaagttcactcataggtcatggcgttggttgacggatgttaacgaaagtttggagaagtatgtatggctttccatcaatatatgggggtgagaatcatgatgagatagaattcgagaagacctaaccttggacctggagttgataccagtaccaagaatagattcactagtccattcatactgtgcctccatgagacgatatttgtcctctgttgctagtcagtcgaggccttctatccttgagctacttcctccaaagagatttgtcaatcgaattctttttgatctcgatagtcggttaaattacaaaaaagtcatcccagtcttggatacgatataccaaagtattccttctggagaagatcccataattcccaaatatgccacccctgacgatttgatgctgtttcaaaaggctttgaaagaaatacgacagaaaactcgtacagaaaacaggtatcttatgcagctagagaatgctctggtagagaaagctgctgaatctggtcaacgagatgccgtttcggtattagcatttactgcaatcaaagatcagaataatcagtttactgatgatgacaaggctcatgccagaaagctaatcaaagaacttatgaagctcaagcacccactagctataaaactgacgggtgatatgttgtatcagtcgaatgctctagtagaggcagaaaagatgtacatgcggttcctagagctagaaaaagatacgatcttatccgctgaggttcataaatctctgggggtcatcttttttaaagacttacgccatttcaaggccagaacacattttgagaagagtataagattagctccattggataaggtgtacgaatcacacttttatctctctcaattgtactcaaatgacgaccctcttcgctctagacatcatttgcaactgagttcatctcaaggtttgagagagagtctagccaatcttggcttcttggagctgaattatttcaataacgcagacattgcatttcaatggttcaaacttggagcagagatcacagacatcacctcattaatagggctgtttgattgctatatgctgaagaaggagtatcacgaggcagtgaacatcttggatcaattgagggatacgcttaccagtgattcatacaaaaatgccataaagacaggtactgaaaaggtaacttgggagcaactacaatcagtaagagcaaagtcactggaaactctgtcaagccttcgtctcctatagacaacttcccctccactgtgtagttgaatgtaaataacttttagaatctaatgacgacttaattattaaggttttcaaacaattattttacagtagacgatagtgtttcagtatttcatgttgaagactcttgattagagatgtggaactatccaagatataaccactgatggttaattcactcaacatatgaattcaccttccttttaagtttatgcttttccgatatagtgtaacggctagcacggtccgctttcaccgggcagacccgggttcgactcccggtatcggagtgatattgaaattttttcatccttaatttttttttcgtgactctgtctcccatctgactcatagactctcgacacagctaggcgcaccccccgcctggtcaaccgccaagatcgcgggcttcgtatataacaacatcaggcagccggagattttttctttcggttggtaacgtatctgttctacgttcataattgttgttacaagaaaatcatggccgacgttgttttaggatcccagtggggagacgaaggaaagggaaagcttgtcgatgtcctctgtgaggatatcgatgtctgcgcacgttgtcaaggaggcaacaacgctggtcatactattattgtgaagggcgtcaagtttgactttcatatgcttccatctggtctggtgaacccaaaatgtaagaacttaattggttctggagttgtgattcacctgccttccttttttgaggaactagaggccattgaaaacaaagggctggactgtactggtagactgttcgtttcgtcaagagctcatcttgtttttggtttccatcagagaaccgacaagttgaaggaagccgagttgcatgagacgaaaaagtcgattggaactactggtaaaggtattggtcccacctattctacaaaagcttctagatctggtatccgtgttcaccatctggtgagtgatgagcctgactcttggaaagagtttgagaccagacttagccgtcttattgagactagaaagaagaggtatggtcactttgattgcgacttggagtcagaattggccaagtacaaggtgttgagggaaaagatcaagccatttgtggtggattctattgaattcatgcacgatgccatcaaggacaaaaagaagatattggtggaaggtgctaacgccctcatgttggatatcgacttcggtacttatccttacgttacgtcctcgaacactggtatcggaggtgtcttgactggtctgggaattccacctaaggccattaacaatatttatggtgttgtcaaagcctacactaccagagtcggagaaggtcccttccccactgagcagttgaacgaagatggagagaagttgcaaaccattggttgcgagtatggtgtcaccactggtagaaagagaagatgtggttggttggatctggtggtgcttaaatactccaccctgatcaacggttacacctctttgaatattaccaaactggatgttttggacactttcaaggagataaagattggtgtttcttacacctaccaaggaaagagagtcaccaccttcccagaagatctccatgcccttggtaaggttgatgttgagtatgttactttcccaggttgggaagaggatatcactcagatcaaaaattatgaggatctgccagcaaacgccaaaaagtatttggagttcatcgaagaatacgttgaagttcctatccaatgggttggaactggccctggtagagagtcgatgttagaaaaaaacatatagaattgatatattattacttgcatctgtttttcaaacacttctagtaaattgttcccaccattctgatacatcctcacctagtgaagagaccaggttatcatcagaatccgaattattgaaaatgtccttttttgagggatctttggagtcaaatttcttagcaattattaaactggtaccgtaggcttgcgactctcctagatctttaaacaaaacccaccaattgcgccccgtttttagtaacttctcatctggaagtagaatttcttgttccgaccttgactccgtggagagtgaaagaatcgattggttcaaactgatcagttgggatttggatatttcctttgcattctttggtttgctggtactattgagtattgacccctttattgtttcattatctttaagtgttaatgtcgaaaatacgtccgaatccaactcaccgaaatcctcatcactacctcggaatgaaatgactgggaatgaactttggtggctatcggatggtcggtcatacaacaaatagtagaatgtagaaggtttagatttaacacaactttgatattctttgatgttttctagaactaacctgtagagacaagtttgccaaatcctgtaaagggagtcttcaagctttctataatattctggttcatttaacgatgcacaatctccacgataaattgctgtaaaggtgagaccagcaacctcatatatcagtaatttgtgttccatatacgtgggttcatctttttgcttgagaaagactaacttatcacatatttctttctcatctgtgttggtatgtagctttaccattccaatcaaaaatttacctcttttctcgttgactttggcatcaggtgtattttctgcatcgtcgttcgcttgaggagcctctagagttggaggtgtttctcctttgttgtaaaaccaactgacttcaggcaaatatccgctaatcgaagacatggcatccaacgtcatagttgcaggatataaaatgttacccagttgtgtggtcaaaaaattcttggatggctctagaaaggataagctttggttggctattagataaaatagattttcacgttcctcctctggtgaggtggggtcaacttctgacggggaaagaacattgccttcactcagattattagtagttagacccactgtcagcgctatgcactgttgataacgaatcagatccacaattgattcctgttcaaatttagaatccttgttcttccagagaacgccgaagttctttataggcgtctttgttgtattcatgatgattatgtccaatatttcaggatcctctgacatcaattcggctaagttggtttccaaagagtcagtaaatccattgggcaattcgatggaagattttctgaacgagtggtcgacatcaacaaatccttcatttttaatttcaaagttgacccacttatttttacaccaagtataccaccagtcttctagcagctgtgtaaacgactctaatggcaactggttataattgaaggagaattcaccattatgcaacctccaccatctatatccttcttgaagttccgcctctgtgtattcaggtaaggctaaaaatctaagagtaaatatcttctcgttcgtagcagtgaccttaacttctgccaaccttatagatagtacgagccagtagtcttgctccacattaagaagaatcagtctagtcttttgtgtatcaatgaatctcagtttgttaccccctctaaacttggaagaaaaatcttgcagtccttcgatcatgcctataagcttgaatttctggaagttggaagtttctgcaccatcaaaccttatgaagcataacagctttcgtttcacctctagctccgtctcatcgagatctgagcttggtatgctttcttcattggattgcaacttggggttgaaaatggcaaaaaattgcaaccctggatacgactgaagcaccaactgttgtccagctgattccataacgacccaaaaggcaaactaagatcaattagtaccttgagtatgcaaaactaaagaattaaggcctggccttaacttcagggttatcatggggaaatatcaatccgcgaagaaaattggtgagagaggcatccaacatccagtatgtattcagattatcctgaaccccaaatttcagctttcttttcaggcaatcgatggttgaagatacttcaaaactgaacccttcaaagttgggcaccaaagagtattgggatgatttctaccagttagaaactgcaaatttcaaagaagactcggagaatgttggtgaatgttggtttgacgattcagatgcagaaaataagataatcgaattcttgttcgacagaatagaggatggatcctcagagttcttccacagtaattcaagagtatgtgaccttgggactgggaatggccatttactgtttgagttgaggaaggaaggatttagaggtgatttggtgggattggattactcagaagtttctgtggagtttgcaaggcagattgcccaaaagcatgcggtgaaaggaataacgttccaacaatgtgatatattagatgaaaaatcgtccgtcttaaatgatgagaatgacaaatttgacattctcttggataaagggacatttgatgctattgcccttagctcgtcaacatacaacggaggtaaaactggaattgaaatttacccttctacagtgaaaaagctactcaaaaagggaggaatattgctggtaactagttgcaattttactgaatctgaactgataaagcacatcacgaagaatgatgagtttgcagaagaaaaacatatcgagtatccaaagtttgaatttggtggtatccagggtcaaacgatatgcagtatttgtttcatcaaaaattgaaaacatcttattctattcatttcggtatgagctccgatactctatcatacaattcgtcccgactcgtaccactacccactttaatggagtattgtaaaggttttccgtcttcttgaagtgttattcgaagaaatttttcactctgcagagaactctccatgcctttatcaatttttaaacctttaaccagcggaatattcaacaaagatctgaaagtggcatcctgtctcatcactagtttataaaattctgtatcagttttgtcaatcaactttaatatacctatacctttctccttccagccttcttttatggcatccaaatcgagacgataaagtttagatttcaccgaatacagtgatttttgttcgacttcagccgattgctcttgtatattcaattgtaccttggcaaaaagcggtattccctgagtagagttttctttggcagacttttcagttttttcagtattgtcgttatcttcagcttcaggggtttgctcctttttcgaatccaaatcttcaaatacggattttttagtcaatgtttttttaaatgcattaccaaaggaggatcctgttccaaaaacaggctttggtttctctgcagattccgatcctgattcatctttggggtttgaggtccggtctggttcgtctttgctatcttttgactctgcattggtttcttcttttgaaggcttcgctccaaaaacgtttttatttgtaaaagctccaaatcctccgacgcttgcaaacttcgttttttgaccaaatacaaattttggtttttcaggtaatgggggaggagacttagcggagtcgtcagcctctttaccaatttcactatcagtgggaagcgtactctttactttctttacctgttcagaatctgcttcggggtcagtttttctttttttaattggaggtaaaggaattggcttctcaagtggatcctcttccacgagagtcttttcatctgtgacgtttgctccctcgacactttgggataatttctttgtactgtcaccttcacatttagagggttcttccttcaattgctttggatcactatcttgtgaagcttcggcttcgttactactcatttctctggaaaggctggggaagaacaaagggcagacagaactggtgagtttcgtggttttgatggaattgatattgggaggggtacactaccaaaaaatatcaccagagttgggaataataacttccgaggacacaattgaaatgtacaggtgacttgccgcttataggatgatataggaagcgtcggcatttgttgctgacatgggtaggaggtgttttcattcattgacgctttaggcagttatagaagctttcttcgtttttagggtataaatttttagtctagacggtctgcttctggtgatacgggtatatttcatttagctattactgtgccataagaatcaattgatctaatctgagtactatgggtaattctgtcaggaatcgtgtctcatcatccccatctacgtgcctcatgcagaatccaaatcgagacgaaacgtaaatagtaaaggcacgaactgacgcctaagaaaaactcccacgttaaaacatcacaacaataacatcaaactcccaaacaaaatggaaaccattttaagggtcaggcagtcgaatgatgaaacctcatcactgtttgaagttacgtcaggtaatactatccaagtcgatggccaagagttcaagttcgattcaattcagggcggacaagtagatcagcaagagctctttgagcgcacggtccaaccatttctagactctgagataattccacattccaaagatgtaactctattcacgatgggaccgtctggagcgggcaaatcttacaccgtttttggaactcctagcaacgttggattgttgtaccgttctttgagctaccttcttcagcaggtaacaggcgacttggcttcttatgatacagtaaagaagcacctaggcatgaacttaataaatccgacaaaatcaggggctcaagcggggaactcttcggggcatacagctgtgacagtctcgatgtttgaaatttataacgactccattaaggacttatttgccaacagagaaatcaattccagatccgtattagatatcgttacagatccgagagatgggaaactgaagccaaggaatctttcccagttttatgttccaaatattgatatttgcaaaagattgtttgaacttggattgaaaaaccgaaggggaattcaaaagggctccacctccactagttcaggctctcattgttttgtgcatattaactttgttaagatttcgaaggatgggaggaaatctgctgtctctaggttcaccttggccgatctttctagcattgaaagcactaaaagtgctcaagctaagaacatctctatgaaacaaaaatcaatcaacaacacatctattttagagctcggccgatgtattcattctttgagatccggtaaacaggacatgtctttactcagaaccaataagattgctcgacttttatttcatgactttattaagaacaagggaatgaatccgcaattaaagtttttagtcaatctggattcaaatggtgatcagggtacttcattacagattttgaggtacatttcctcaagtatcaatgacgacagaagaacatcttctcgtcctagttcatctggttccagggatagtgtcaagagactttcagtcacccagagattgagtagccgtatttccagtactcatgttaaggagaaggagactctagaaaagatcaaaaaagagaaagatatcttgacgaaagagttgaaacagctccaagataagttagtagaaaatgaaattagcattagaaaagaaatctcaaataattttgaggagtcaatagccaaattgaatgatgaattcagacagaaggagatttctcttcaaaacagtttggaaaaagattgcgatagaaagctcactgacttggcagatgagtatgagcaaacattgtgttcaatgagaagtgagcttgattccaaatcaatcgaaaaccaagacctactgaagaaaattgcatccttaagggatgagttgaaacataataaaattgaaaacgaatcgtttcaatcttctataacaaaacttaatgaaactattgagttaaaagctcaaaaaatttccgatcttaaagtgagctctgccagtttgagagaggaacttgataccaccactgctagccttaacgagaccacaaaatcattaaatgatagtaaagaacttgttactcgattgcaagccgaaattacagaaaagaaatctcttttggaacagagagaatttggttcatcagagataaagcaagattatgagaagcagattagggatctaagaaaccaagttaaaaggttggatgccgatgttactgctggagaaaatgttattaagaaattagaatctaatttagaacaaaagatagcagaagttgacgagatgaagacaaaattatcacaggcagagaagagcatcgattttaacaaaagacatatcgacattctgaaggacaagtttactgcttctaaacaaaagttaccagcctctgatgataacaattccgctactgagcatcccaaaagcagcagagctccagagacagcagatccagactctttaaaagagaatatttctccaccaaaaaaatccaaacataaatcaagttccaaatctcaaaaaatagatgacgcccttaaattgacatctttcactctctttgacaaattagaaccccaatctgtcgattcgtcggtgaaaagaaaacgcaatattctcagttcgccaacaaaagccagcgatctgctcatgtcatctcctacgaaaactaggaagaagttaagaaagaaagagatagtcaatattttcgatgacaatgagttagactaatcaccctatataagtacaaatcttttgcttgaataaaaagtgatgaaacatgctagtattgtggattaattcctttttaccaatcatcgtcttcttcctcttcttcatcactatcacgtctagccttctggcgaattgcagcggccaaccctccggctaacgtagactcatcttgcttcttttgcattagtgctgcagcaagtccaccagctaaggggtttgatacagaaccattggtcgaggctacttgcggagccacttgcggagctgcaggttgtgcttggactgggactgccttagtagcaggtggagcacactccactacataggcagcagggacccaaccctccttagcttcatctagagtctttgctaaccaccaaccattttcctccttttggaggatataaacaatttgatccttttggattggtaattcagaaggactgcccgttccttgaaattcataggctgctttgtaggttggatattttggagtttcaactgctggtggaggtggcggaggaggtggaatgttcttcttaacaggctctataggctgagttggctgcgagcgttgaacaggttgagtgcgttgcgttggctgaacaggttgagagtgctgagtcggctgaacaggttgagttggttgaatccgctgaacctgaggaacaggtacggcgccaggaatgtttgaagttcttggtttttgctgttgtggaggaggtggagggaccttttttcgttgagttggctgaacagctgcaactggaacagattgagcatgcggattagcaaatcctgagtttgccgcggccccatagttgttactgcgttgggaatatgagtttgaaacttccacaccagtacgatatctgtaaactgcagtacctgtgttttttccctttggtctttctttggatacagaagaggctgaaagccctggagccacttgaatagttcctgatttgtacacgtctccatttaagggtacagcagtagattgttgggtcttgatagtgtggatcttgccaggcttcttgtaatattgaattgtaggcccgatttgtatactcagtcctcgatttatattcttcagatgggtgactaactcagttttgaatttaagattgataaatggatcaggccttgttccccctattaacgaaatggccaaccaatcgtcagccaaattcgacataccaacatacgatattgaattaacagaaatcgaatccacattatacgagatctttctttcgatgacttcctccgcaatcatatagaaggtagatcttgtcaaaaggaaaatacgaggcaccctgactgaagatctaccaaacttggcgtgtagaatttctccacggaatgaaaagattattctatcattgatgcccacttgagagattaagaaccgaccaaaacccgatttatcgttacaaccaagatagtctcccgtgtattgtctgcttcccaacatggacattctccgtctctcctttttgtgaataactagagatgtaccgtaatctctcaattgctcgtaaacattaccacctttcttctcacggatgatcctttgcaaggtcttggcagcgtcaactctaactttgaaccatctacggatggcacgttggataacttttgccttatttgcccagtagttctctctcattgactctaaagaaaacagggtctcaggtttcttaatgaagatcttagtcactccaacttgccattctgtttcgggaatgccagcgtctttaagaataactgtgcaggctgacttatggtctccttcccaaatataatcacctgcataagatgtctttgttgataacaagtaaaaccgctcagaaaacttttcaaatgtctgtcgataagcaaaaccagctcttctgatacgaacattctcttgcaaacccaagtatttcacctgatgcagtacagctctatcgtcgtactcagtgggggatttgttttgatttggtttgatcgttcggatgtatgaaggttgagcttgtgagagggtgtccaccaataagttagcactagttttgatttttgcacttgccgtagttggtcgattttttctaccaccagcattggtttcgacaggttcagggaaaagactcaacagaaacgagtcctgtgaggttttgatcatttctaaaagatcctttagcatctgatccttatttttgtcagtaatagtatcgatgtcgtaggtgacgtcaccggcataatgtttgataacgaactttgacgaacgtaagtcgaaatgagggttcgttgcaatcatgttcagtctttgagaaaatgcttgatctgctgcactactatcagcatgagctgtcgcacaagcatcgtctaaaatggagaaaattcctggtggcctcttagcttcaatcaaatcgcatacaatcttgttgttgaagtacttgataggcgtccactgaatttgctccttgacgtactcatcctgttcagatttcagggtcagctgaataaaaatctgttgtaatttttcgttgacataattgatacataactgttcaaaagaattctgttcaaaaatttcaaacccataaatatccaaaattccaatggtcttgtgaacagtttcacttatgtgagctaaggatttgttggtcctatcaacaatccaatcgaaaagattactatagatacctttagagagagcatctctgacagcagttgcctgagtgatgttcaaaggaacgtgataaatagacccacgtttcgatccgtgacttgtttccacaatacgttcgatcagtgagtttgtaagaatctgggcgtttacctgaagtaggtatgcaacgaaatcggttacggaagaatctctaatttgagcatttccatcctcgttttcaacaaaggagatgttaccaatccataagatagcggccagaattcgaaaaacttggtcctgctcatcttgggtaaggcctattgtttgcatggcttttagagtgtctttgtactctttaacatcatctatcgtgtcaacagtagtgcaaccagatgcacttgtatagacgtactgttcgggaagctgtacaccaaaagtcgaacgatagttttcattagcacttttagtaaactggtagaaaatgtgaaagtttctttcatttcgaatttgaccaaccactctttgtttttctagcaaataattggtgatgtgggctccgattggttcatagcctgcattgaactgaatttctaagtatttaccatgtcttgaggagttattattcctcaaggtcttagcacacccaaatgactccaataaaggattggtggccaagaccatatctttgatctgctgaatttgggacgaagactgcccaccactgacggcagcaatatactgcatgatttgtttggcagcctcggtcttccctgcaccagactcaccagaaataataacacactgactctctgcgtacgcttgcatgttgtaaaacattgattccgcaatagcaaacacatgtggaggaacctccaatctattcttacctcgataactgttaaggatggcatccgtgtacagccccaaatctctgaatggattgactgaaatcaacacatgaccgatataggtatagatcgtaccatttttgaatcttttttccaagttctcgttgattgagttgtcactgattgtggatagaagtgtcagatcggatacaccaacctccttcttcttatggacatcaaactcagccttcttgactcccccccttttggcgggttgctctctgacttgtttgttgcgaccgattcgctttgtaatcgccatggtgaaacaattggttctttagcgttagaaggaagcgatcacttggttgaaactgtacctaagccaccggacccgttgtacttctgagggtatttcgaggattgcaaggggaatctttttgttggtgaacgcactacccttttttttacatagaaatatcagtaggaagtgatgtgagagtgacaaaggcaagagaagttttggtctgtcaaaaagaaaaacaccaaacgacagcctcgagtcatgtgggaagactttttctctgtacagatatttttcattatattaagggagactttagagtctgctattatcgtgtcggttttgctgtctttcctaaagcaaaactttggctcagaagaccctaagacttacaagagtttgcagtttcaaatatggtttggcgctttgctgggtatgctgatttgcttggccattggaggtgcgatgattgctatattctacttccttggtaacgacttgtggtcgttggctgagagaatctgggaaggtgtattcagtatcatctctgccgtgatcatctccatcatggggttggccttgttgagaataaatcacctacaaaccaagtggaagtccaagctgggaagaagtttcacgttgaagaacttggatgatatcatcattggtgacaccgacgtggcccagttgagcagagttggaaaaatacgctacaaggtgaaactattcaccgaaagacatgcactggcactacttcctttcattactacgatgcgagagggactagaagcagtcgttttcattggcggtatcggggtcagccaacccttcacatcattccccttggccattctggccggtggagcaaccgggtttttcgttggatggatcatgtatagaggggggaacaagatgcaattgcagtatttcctcattttgtccacagctttcttatacttagtagcctctggattgatgtccagaggagtgtggttcttggagttggaaagatacgtccagttgtgtgatggacaggatatgtccgaagtcggatcaggacctggttcatatgatgtgagtaactctgtttggcatgtcaactgttgcaatggtcttaccgacggtggctggatgctgttgaacgcactggtaggatggactaactctgctacctacggttctgtcattagttacattgcattttggctattcattgtggcatctcttaaggttagactgttccgagaacgtaatgggtacctcccattcattcctttctcgtggcaaagacgtagaattcgcaaacagattggtatcttgaaacgggcaattgcaactgcagacgaccagtattcggaggtaaacagcgaaggaaggccttccttgactcaacagactgagacaactgtgagtgggaatgagattgaggatggagagagggatacattactgagctagatgttttacatgcaaaaatggggatgtgggaacataccatgttactcgtaatctgctggagtgtagcaacctgcggggatatttcacaattttcacaattttcacaattttcacaagtttcaaaaaacgcagacaagaggtctgcattagtgcattcaactttctcaattaagaaaaattaccgaacccttttcagatcgtcaaatcagagaaaaaataaggcttaatctatagcaatgcgtacatagaataattgcctgaagtatactaaaatgaatgaatttgatccaatgatttcagtgagggtaattaccgagataagaaatgtcagcaaatctaattgtagagccctctcccgggtgctatacggcaattgccatatcgatcgcatcctttttcttcgtccgaaaggtgcatacatgtcccagcgttgaatctgcccatctattaaagtgaggcgcgaacacacttggtcgttatctcttacaaaaatattattaatcccttaactggcaaaaacttccgaaatgccccagtgttcagggatcacactaacaggaaaacgatgcaagataaacacaaaaacggacaaatactgcagataccatgaaaatcaacgactgacgacaatgtacaggaaacctgcatctccaccaaaagtagggttcatctacgtgtacaccctgaaatcattggcacttcccagcaacaagaagcaaaagtggcttcgattgggtagtggtaaccactctagagacgtcgacttactgaaatccgagccctttgatcccagggataatatcttgattaaagtgggcgcaaccactaacgatccacagactcgaattcgtcaatgggaagataaatgcaggttggagctagcgttgataacacccaaattagtgatagcaaattcgaaatcccgaagggggctgtcggcactgtttgaaaaattgtctttgaattcgtcagctggaaggactgagagacaagagaggaaattgctgcggcaatggtctacttataacaatttaggttttcaatgcgacgatgtgtttgccaaagaagagcaaattcattcactgctaagagcaaattatgggcatggaacagttttctgccaaggatgtagcaggccagggcggaacgtttttttgaggcatagagagtggtttcttatcccaagaaggaaactattcaaggttttggttctcatagataagacttccacgtgaccgtttgtatggggcatctcatgccaagacctggcatgcttctcggattatgcaaagactgcatagtacatctaccagttaagattcgtgaagaatgaaatttatcttctgctgctatcagtgaaataccatttttaggtcaatggaggggttggatggaaactcgggagataggctatgaaacgtgctgtcgttatctgttcaattgccatcggattgaattatataagagggaagtaatatctctcgtgagttctcttttcttccttcttcatcccactcatctcacactctctctccattgacaaggaaaagaatgcgattgaccaaccttttaagtttgacctctttggtggccttagctgtggctgtaccagacttctaccagaaacgtgaagctgttagctcaaaggaagctgctcttctgagaagagaagctactgaatgtgtttctaacgagaatgtcctcgttgaggctccaaaatccaacatctggaccagtctgtctaaagacgaagttcaggaagtattggacttgttgcattccacttacaatattaccgaggtcactaagtctgacttcttctccaactatgttctttggattgagactttgaagcctaacaagactgaggctttgacttatttggatgaggatggagatctacctcccagaaacgccagaactgtcgtttactttggtgagggtgaggaaggatactttgaagagctcaaggtaggaccactgccagtcagtgacgagaccaccattgagcctctttcctactacaacaccaatggaaagtctaaacttccattcgatgttggtcatttggacagaatcaagagtgctgccaagtccgctttcctgaatgaaaatttgaacaccacaaccatgagaactgttcttgaagacttgattggtgttccttacgaggatatgggatgtcattcagctgctcctcaattgcacgacccagcaactggagctgttgtcgactatggtacttgtaacatcaatactgagaacgatgctgaaaacttagttcctactggtttctttttcaagttcgacatgaccggaagagatgtttctcaatggaaaatgttggagtacatttacaacaacaaagtgtacaactctgctgaagaactctacgaagccacaaagaaggatgattttgttagattgccaaagattgacattgataaccttgattggactgtaattcctagaaacgattctgctcctattagacacttggacgacagaaagtctccaagattaatagagccagaaggacgcagatgggcatatgatgctgacgaagagtacttcagctggatggactggggcttctacacttcttggagtagagacaccggtatcagtttctttgacatcaccttcaagggtgagagaatcgtttacgaattatctttgcaagagttgatcgcagaatacggttcagatgatccattcaaccagcacactttctactcagatatttcttacggtgtcggtaacagatttagtttagtcccaggttttgactgcccaagtaccgccggttacttcactactgacactttcgaatacgatgaattctacaaccgtaccctcagttactgtgttttcgaaaatcaggaagactactcactactacgtcacactggtgcttcttactctgctgtcacccaaaacccaactctgaatattagatttatttctaccattggaaactacgattacaacttcttgtacaaattcttcttggacggtacccttgaggtctctgttcgggctgctggttacattcaagctggatactggaacccagaaaccagtgctccttacggtctgaagatccacgatgttctttcaggctctttccatgaccacgtactgaactacaaagttgacttggatgttggtggaaccaagaaccgtgctacccagtatgttatgaaagatgtcgacgttgaatacccatgggctccaggtaaggtttacaacaccaagcagattgcaagagaggtctttgaaaacgaagatttcaacggtatcaactggcctgagaacggacaaggtatccttttgattgaatctgccgaagaaactaacagtttcggtaacccaagagcttacaacattatgcccggagcaggaggagttcacagaattgttaagaattctcgttctggaccagaaacccaaaactgggctcgttccaacttgtttttgactaagcacaaggacacagaattgagatcctctacagctttgaacaccaacgctctttacgacccacctgttaacttcaacgctttcttagacaatgaaagcttggatggtgaggacattgttgcttgggttaacttgggtctgcaccacttgccaaactccaacgatttaccaaacaccattttctcaaccgcacatgcttcctttatgttgacaccattcaactacttcgacagcgagaactctagagataccacccaacaagtttactacacttacgatgacgagactgaagaatccagttgggaattctacggaaacgattggagttcttgcggtgttgaggttgctgaaccaaacttcgaggaatacgtctacggaagaggaacccgtattaacaaaaagatgaccaactcggacgaagtctattagattagtcgatagattgagtctaacttagctaatggagctacctttccatttttgaattcttttccgcttttttttcgttcttatagcttagctaatagattttttaaaacttcacaattcaccatagtaaggctcggtctattctggtggtcagggagagtatctgactagcaagttacaattgtcttattcaagaattaaagtaatgttagatagttgaggttagagtgtggaaagtactgactaaagagactgatagacttataacgtccaagttaaaagatgggtacgtagaattactggttttcatctagcaccaatgaactagatggtctaagccctaacggagaaaaaatgaaaaaaaacgacctcggtgagggttgaactcacgatcttgcgattaacagtcgcacgccttaaccaacttggccacgaagtcctctgcgtagttttatgaaaaaactttctatacataattgtctttaatgctaggtcagtcgacactagtcaaccatgtggagggctattgtactcccgtttagtgtcctaaaaactgataccagtctatactttgtttattagattcataggttggcactttgaaagtataccctctttttttaatctggcatcatgtcttctgtgactgaatgtcttcacgttgtttttggtagctctagtcctagttgaacagaatgaaaatatcttgctaccatttgagtttctatacgctacgctgcctaaagtaataatattcatgtgattaattacgacatctctttagcccatgaagtttagtagactgatgatgtaaacatcttagtggtgtgtcaaaaattacaggttaggatatttctctaaatacactaagtgtcaagttgatccagcaacagtacatttacagccatcaaaatgaaagtcattaggtactagacctatttcttttctcaatttctgctttcagaaacgatatgtctcccttaatatcagaaacaatgtgagcagttctatttgtcaattttgcttgaggctttccataggatccatagcctagagctcgtttaaacatcgaatctttaggatgctccgaactcaatccttccatataattctccagctgtttcacttgaaacatcaggggttgcatttcgctcattcttgaagtgtcgcctcgtagggatagagaagcaccggcttgcttgtaacttgatacttccaacttttctagtgtgttcttcaagtcctgaatgctgccacctagacgatcagattcactcctgtctctcttttcctcttcatcttcaaacttgatcgtctgtcttccaaacccgttgttctggtatttatgctggtacaagaaagggttgaacgtattgtctacctcttccttcttggggtccgtttgcatccccgcatctgaataaaccgtgttgccatacttgactctgacttcaggaacaaatcttaatcgttttgctacaagcccatacatggcattaagtttgtccaggcaatggtttaggtaggagcctcttctttcgtattgaagcttcaacataggtcgaatcagaaagagggccaatgcatacacaaccaccaaaaacgaaccggacccgtacaaaagacgagtcaaatagagcagagccgcaggtttgggagttaccagccttgaaggtggtaaattctctgggaaggcaatggcttgcacgttgcgccttgacgacatgttgtgaatcgatgtagtgtggagaagttaatgagagaaaaagtgcttctcatgactagttcgcgatgtagtaggtaatctggtcggttaataaccgaaccgaggtggtattaaagcggaaggacaaaagaaaataatacaaaaatcacacattacataagcgcttagtattcgacatcttgatccagactagaatcaagggcgacttcagcataatcgttctccagagcagctagatcttctcttgcctctgcaaattcaccttcctccattccctcactgacataccaatggacgaaagcacgtttcttgtacatgagatcgaacttttcatcgattctttgccatgcctctgcaatagcagttgtgttggagagggcacagaccgacctggtagccggtgctaggtctccatcagggacataatgaggaggcttatagcataacccaattttgaatcccgtggggcaccaatcgacaagttgaatagttttcttgtttttgagcatcgatactgcattctgaacgtctctgttaacaacatctcctctgtagagcagacatgtggccatgtatttacctgcctttggatcgcatttaacaagctgattgcttggttcaaaacaagcatttgtgatttcttgtacattggaagactcatgactggacttgcttttcgatagcactggtgcaaatgataccaaagggaagtgaattcgtgggtatggaaccaagttggtttggaattcactcaagtcaacgtttagagacccagagaatcttaatgatgctgtcacagaggacaacacctgtgctacaaccctgttcagattgtcataagtagggcgagctgtatccaagttcttacggcacatatcataaatggcctcgttgtcgaccatgaatgtacaatcagagtgcataagtgtgctatgagtgctcaaaacactgttgtaaggttctactacactggaagagacctgtggagcaggatacacagcaaaatcaagcttagtcttcttgccaaattcatttgaaagctcttcgagtagaagtgcaccaaaacctgatccggtacctcctccaaaagaatgagtgaacagaaagccttggaggccatcacactgatcagccatttttcttagacgttccatcactggttccaagagttctctgccaactgtgtaatgtccccttgcgtagttgttagctgcatcctctttccccgtaatcaactgttcttggtagaaaaggtctttgaactttccggtacggacttcgtcaaccacatttggctctagatcgacgtacagagttcttggaacgtactttcctgatccagtttcgttgaagaacgttgcaaacccttcatcctgtactccctttttctcatcctccaagtgccctgtagggtcaattccgtgctctagacaatatagttcccaactggagttaccgatctgacacccagcctggcctacgttaatggatatgacttctctcatttggtaaaactagagtgagagtgtttgtttataggcctgatcgggccaaatatttacatttgcgcattagcgaacacacgacgcgaccaaactccaaagctctaaagacatcaaaaatcattatcatacatattacgtaatagtaagggtacttagattgatacactggcacaaagagctgcaccgactcctgaaccatctttggcgatgttaatgtgcgtacgacgttcacccttggtgcctatctgtgttaaggctaatgcgtcacgcaacattgtacggtaacctgggtaaaactcgacaacagatccatcaacaccaatgtccacctcaatgtggtgtccctctaatgcgccagtcaacatgatgatggctgcaattgggacagcagagatgtaggcagaacgtctagaaattgccctagtcaaagcttggatggcttgacgttcctccaaagtggtaggcaatctcaatgcctgcaacagggtaacttctgtgggtttcatgtccttcgaatcatcaacctcaaacagagaaagattctcggaatccaaatcccaaggggttcggagacgatgtggaagactttcaaagtttggatactgagtgaatactagaccacgactgtgaaaatcaaccaatatatttcttaaaatttcacccatgaacataccggaaacacgtttctcaaagagatggataccagggttggcagtaagtgcgtccacatccctatcgtacttggtggttggaaggacctcaagacggttgtcgaaagaaccccattctgtgttgatcaccatgtgtgtcacacccttagccttcaggtcctttacaacagcctcaggtaacttcttgatattgtcaagtttctccaagtaagctccattggtaccggtaccgaaaatggcgccgattatggtctctccttgtttaccacctgcaatagcattggcagagtaggctctggaaagcaaggtaccgacggtgtcattggccaaagcggcaacatggactggaattttccctgcatccaagtgcttctgcagcaattggacgacatcttggtccacaacgtcagggatgttgaaacctttagtccagcgtaccaaagatcctgaatccaaggagtgctgggctgttgggaaactgaaggtgaagcccagtttcaggtaattagcacgactgtttgtttcatgtgccgcttccaaagcatcaccgtgatgctcttccaagaatttccttatcttggaggccaaatatgcgaatagttggtcgccagttcctaccatcatatcagcaggaattggggacttttgctgtaccaggttgaaagtgttgtctcccttcaaatgaacggagcagactctaaagttggttccacctaaatcagcagccagatatgtacctttttctttaccagatggaacttgggtcacgtaggcgggaagcattggcatacccaacttatcttcgttagaagcaagaccttttttggcaagttcaatgaatttgtcaacagaacgttgaagaacctcctgactgacgtcgaaggaggactgaatctcctttacagcttcttgcaaagacataataattgtagatttcggggagaagaggaaaaaaagaggagcaagcggagtagatttatagagttttgtctagtagtggtgatatctcggtggattgcgcgaatagttagcagacatcatccaagtgtgtagggccgcataattccgtgctaagaagaaattctcgtcaggccataacgtccttgcagtgaaaaattaattgtcaatttgtggctaaattaagcttgatactttaatttttttcagatttaagctctattgtcgttcgcccaggtcctaagttagtcctttatgtgtttttcctggtccctcctactttctatggctcgatgacttcggatcattttcagcgcagagccatgaattcgcgaatatccggagctgaacattccacccctgcgttcctagtaaaaagacatgacaacaactttggatccgaacaccaacacaccccgccccaccactgaattgttcatttctttttttgctagatctcacaacatttgcgacatgtttccatgtggtaacacctattgatgtgtatgcaggtcttttgtgatctctcttacccaccaagccaaaactctctctggccttcctcttccctccttatattctttcacatgatagggttgaatatattggtgggtaagtgctatcaaatcactcaattgctttgctttgcagctaacatgaattagtgggagactctccagcaaattggctgattgcttggagactacatgtagctggatgcgtgatcagcgtagttttggaccaagccgtcaaagagaaagataccacagaccttatgataagctggaagtcgtcaaggtttcaaccttcgtcctaccggccctctcatcttttctttggagttgatgatttccttcaacggtgcatcacgcaggaaccctttaacctcctgctcgtagcggccaagtctgttgacgaacatagaagcatttgtcaagcaataagctcatacttagcaagagacgttctcgtacttgtagactcttctttttgcatatttttagagaaaatagttttggaactgttaccacatgagtctgtgatactctctctgctgtgttatgccaacatacaggaaaataactcgtttgaatatacactacaaggaaacgaagtgtcaatcttcataggttgctctgacccacattgtaaggatacgaaaatcattgaaactctgcaagaaaagagtgcacaaggcaagatattgcaaagttttctccaagctttacaaaacggtgagattttcccagtgtcctgtattcaagtaggcattgagccccggatggattatctcttatggaaccgtttgttgtcattggtagccattgaaactttgtgttggtcaatggatgaaccagatccaaccaagttgcttcaagatgcagcctttgctcccatcgtcaagggcctattctacgatttattgaatctggctaacagtgctggttgcaaagcactacccacctcaagcgaaactgcaaggatcgatacccttatcagagatctatcagcgaagtacactgcgaggtatccgccaaacatgcacacggccaaactgtatcattcccagtctgccccgttgttctttcagcactaccatctcaagaaaacgtgggtcaatctctatcttgtacagatccttcagatggcagaagatttctcattgcatttaccgtatgtgaactgtctgtttggttattctaaagttatgaaaaacgttactttacaactgcgtaaagcggaacaaacaagtcatcaaaacttcattctaccatctctgcaacaacaaattcaagttgcgccaatcagtaatagaaagggttgttacactccatcccacctgaatcaccttgcaggaacaccaacgtttcaaagtactaagactgcccaaaataaaaagttcatcccacgaagtggatcaaaccagtccagtcaatctggaagacaattacaatctgcttatgacaggttggcacaccgtgcaaatatccattatgtattcgacaacaccacgagcaggtatggtgaggtcagcagtgatgcaagcatcaagtccaatagcaacaaaggcagcaacaacaacagttccataaactcttttgttgatcaaactactcaagtggtggaggagcccaacccaacatttcccacgataacctgggaagctggtaccaccgaaggtggttttgatgtgccaccaaacctcttttaagatcatgaagatgacatacattgtaggtctataaatatttacttaaagagccatagtcagccattcccaacttccctgaccatctggacccttccctgagctcttagggttcgttgagccgccaacactgttagcactgctgttagtggcgtagtcaaaaccggaaaaagtatccttagtctctttaactaatgggataggaggggggttctgatcatccccaatcgacttagcagaaggtttgggtttacctgttccgttcaccttcgtttcattattcttatctctttgtcttttcttaatgacatcagttttcaatgataatggtcgtacagagccatgaagctttaagaacaatccacaagcattacaaaggggttttccagatggatctcttcgccataaaggcgttgtttgagttttgcaattcgaacatgaaattggaataccattgttagtttccttcaatttcataccatcatccttgggtttccgggaagaagtgggtttcttctttgttgctgagagcggtcttcggatgcccgagccagatgagttgacgcttgaaaaaccttcggcctctttatattggctttccagttttacagagcctgtcagctccttgttcattaattggaatggttcgatatgcgtgttttcgttagcgccaaaggaatgagccatggccatggtcggattaggtattgatattgtgttttgggggatcgacctagaaagctccgcagaatctcttgctcctgcagtccgtttgaattggttttggtgggaggaacttggcctgtttgagggtccgatgctaccaatgccgccaatagaattgaagtaggagtcaaaataggtcatcgagtccttagcgtccattgatggtgtttgagcagttgagcctgtggtggagcccaacgtagagccaggagacgagtacatgtcagtaaactggctcatatgagaagatattggagttccatttccattcattcgatgaatatgctggttgctttgattattacgatggatactttgaccctgaggttgctgggagatgtcaaagctggtatctgaaaacatgttcatttggtcaaggttgaccgcacttgaattgtgggaaatcgatggaggaagggagctctgcggtaacccataaggaacagaaaactcttgcgaactgagccccttgtgaagatgagattccggaagactttcagagacaaaattgagaccgccatcaaaatcataggaggatgaaacatcaaatctctcaaaggggattccattttcctcccaaggagtagtgcccgatattgactgatcgctttgattagtctcatcaaccatcatcatattatcgacgaatgactgagcattattgtggatctgactcttgtcggggttttgacttccttgagacttgagactagcagacagtttactgacaacccgatgtctctgctgcaagtcaactgtgggaattctggtggtattaccgggatcctgggttggaactaagggggaaaactctgcaggtctctttttcgacaaagatttggaatctaatccaacccgaccggctacctgcgccgttaacggcaggtcgtccatcattgtggcatcattagcttgggagaatgtgttgggaccaatactattattattgtttttgttgtttgcttggttcttcaacttgatggtcatcagtctccatgtcaggttttccattctggacttgtacggcaacgacgtcttggccttagaatacatcctccaaagttctctttcggtgtttgaatcgtcattgatcacagagaggccaatatctttattggactgaaccttggtatccaagtgaatattaggcagctcatgccctttcattctcgaatgaatttgattgaacaagtggggattgcaaatctaacaaaggtcaaatcacaggacggcacgcaaaactggtagacggggcaaagagtttggtggatgaaacttgcttatggtgaagggtaaattagaagttcgaaattgtaccagccggtttcggtgacaataaccagaatcggtagtaatttaccgggcctctacagggtgattgtcacataaagatcctttgtggagcgtaatgctacagattgtttatagagggaggtcttatctattgatttttattggtcggataagttcaaacatgcatattgataaatggattaaattggaatcggtagcgaccgttattctcggaagtcggccggaatggccctgactattattcctcgaattgttgccaaccacacctaggccgcttcttcccgatatcccagaatgctaaggtttagtgggtggtcatagctaaacgtggcagacacacttcggaagactagagcctaagatcctaacccatagtagggcgaatgttccacaacacgtaaaacgttctggaaaaaaaaaattaattctctcacttcataagattattatactatactataaagcactataattatttcttggtggagtcggcaccattcttggctccagagaaggctccagagatgtactcactggtgttggccaatgcctccttaccagcttccaatgcatcaccagcggtgttttgaacttgctcaactaaggtaggttgggtctccttgtcggcctcgtccttaccgttcttgacagcgtcaccgactctttggccgaatcccttctgctcttctggggtcaatttgttggcagccttgtcaccagcatcggtgagggtctccttggtttgctccaagtaagtcttctgagaatctggtttaagtccttcagaaactttgtcggtaaaatcttttcttccttggtcagacatttctagttgtgtttgtgttttgtaactgtttaagtgtgaaaaataaaagaagtttagcaggggaaaagagtgtccatttatactaagaaaggtgtccttatagcaatcttagtaaagtgattgctatgtcatcatttagcaatcatggtttagcgagcaacaataggggtcaagcaccctgtgctaaaatattctttcaactacgaaattcgcaataaatgccttgtgaagacaataacaccccgttgtaccgcacaattgctctgcaaaatacatcacacctcacaattgcttagcaatttctattacatcatagctgtgatcgtcaccaagcttccttctcttactgaagaccgatctatgacaacacctgaacaccatcatcatgacacgaccactattacacccacacaccaaccaccaatagatatttgttaccacaaatcaccatgtcgtgttaatttcaatgcaactaatttgcctaatcggggaatattcgctgatacccacacaaacctcttccaagactaaggaaaaaccagccatcttcaaatctcccgtcactctttgatctaacctgccagaagtgctactttactttattttttgcttcgacctcattttgtttgcttagagtggtgactccctcattcaccttctaatcaatggctctcatgactccgagtactccgcccagaagtaaccgcgtacaggctcaaacaccgttcacacccaagacaccaggttcctccgttactcacaaccccgtcaagaaagatgcccatctgaaaaccccacattcaagaaattccagagttatggaggtgaatcaattaactcctgacccaacaccgcaacataggaaaagaaaacaactcagtgacgccatatccttatcaaccacttcatcgactagaataccttcttcacgtcaagaatccaaaccaacatatttattcccacctgcacaaccccgtattggttccggtcgttctttatcgtctagaagagctagcatagattcccgaaatggtttgcggaaatgtgcaatgtcgccagttttgagtgatagtattcagttcgaaagctctgatgaagagatagaaggattgcagttgaaatcacaaaagcctgcaataaggacgcttaattttgatggcatcgatagtgatgaagaagaacgtcaagattataggcaacgtgaacctccaagaacacccactaagaaaatcatcaatgaagagctggcaaaacagtggaacaacccatcttcgtacaacacaaagttcagctccgagaatgacagtgacatttttattactagatccaaatccaagaacccgtttatagggccagccaaaaccggaaataactcttctctccaagaaactgacgaaattgtctatatccacaataaaacaggagaaagaattgttcgtaagctttcggatgaacaaaaaagtataaagccgaagatattagattttagtgctacactggacacggatgatgaaatcgacgaaaacgatcaagatcataagaacctggtccgcagatctactgagtttgtgaaggatatcacagtatctcctaaaggcaaaaattttacggtgttcaaagattcttgagacgttaataatcagggttttcagttctttttatgtaagatgtagataatggattaggatttggatttgattattcagctagtacagaagttgtggggccgagtccgttggcacggtccggtgcagattcaccctcagaactagatacttttctagtcacaatgttgtgtagtcggttctcaacagatctggaactagtgtctatgcgcttcagttcattaactgctttcttagcgactgatgttggaggaacagaagaagctggactcaaagaggtactccttttggctgaagaaacctgcttcttgaccttaccaaatatttcttgcttgttgtttaacaaatcaagaaccaatttgtaacaatgtttgtcattaagccctgtgctatgaccggagttgaactttggtctgagaaccaaggtagagaattcatgagaaatcttctccttgaagtcattgatatgtctctgttgtaatgccgggtcttctgtcttgttctgcttgaccgtttcaattattctattaaagtgagttaggattgcatctagtgtcgcaatgttattagttggaagactggtcaggaaactcactagtccgttaattctctcgtttgtttggtcagcggaaccaaattggttatacagagactttatagagtcatagtagtcacctgttaccaaagaatcaggtagttccaataaatacagcttcaagacatttgtaacgacaggagcatcatattcggccagaattttttcatagctttttgaatccccatttagagcactgtcactatccaataggatatggttgatacgctttctaagttcgtgtgtcatcgtgagctgaactgggcttgtccagcaactcaatctgacgtcatcattttccataagtccataactatggtccatatgagtcaaaattgaagacactatcaacggaacaatttttctttccatccggcatctgatactcaattccactccgaagatctgtttatttttcgaagactggaaattgtcataaaccagagatcgtggtctgtaatatccagtctggtaattctctaacacaaaattcaagtctttctcaggttgcatattttcctcagccactgttaaccctgtgaaaactgaatcaagtttaattaaatagtctgcctgactaggagtagcagcttgattgaagaggcataccaagaaatcctgtgttgccttttttagagctctcaatcggtcaagttcacacttctccataaattgaagatgatcagtgatagtaacctccagcttacacctttcttcatccagattcaaaacttccttaagataaagcttatccaattcatcacactccctgacaagttttcttatagttgatttgtcattaatatccacgttgctgacacctgagaccaattctttgacttcaccaaaataattagttaagttgtttctattggcctcttgagaaaattgaaaactgtcctggggataggccatctctaagttagcctctttgaatgcttcaggtctccactgataatgtaattgagatcctatagcaaaacttccactatcaatagctcttatgtatccaagattgattaaatcttgaccgaacttttcaattttggcaatatcagcaattccaatattcaattgtacccatgatgaaacttcagagcccgtggaacagaaatcataattcaccaaatatcttttgaaaggtctcttgggaatttcactcagaagtttactaagcatctccaaaaaatcagagtacttgtactcgtagcctgcaaggatcacaggactaccatcatttgaagcttcgttgacctcaacctgagtcatatcttttaggaattcttcaaaatcaacattgcccaattcagatttgacgtcttctaagattcgacacttgttaaagtatttcttctgaatcttatcgacattttgtttatttttaacatatttggtaactttggcatctaaagtcttttgactatatctgacacgttgagagtgatctgaactccatttgctaaagcgatcaataacttcagactgtattcgctctgcaacctggagatgatattttccctcagttttcatttgttcttgaatactaacgaatgaagctttgagagatgcaccatcgtcccttccaaatccaagggaattcaaagagactgtgttgggaatttgcagtagcttgcttccatgattggcctctgcagtcattctcgtctggaacagagacacgaactcgtcgcactcgtaacaaccctgatacagcttctcaaataaaacattgatgcctgtaatgtagtcctcagtccagaagctagtagcaaaggagttagccatatttaaatagtagctttcttgggctgagtcgggtattaggtgtatacagtggtctagaacggtggaaaggggaaataagctgaagcaaatcccagactgaacacgcgagggtacaatctcggtcatgtgatacgtaaacaaaaggcctgttactgaatgaggtacgaaaaccgttgtctaggtaggtaaccatgtcggttcgatatcccagagttcatattgaatattgtgcaaagtgtaaatggggactccgagctaactggtatcaacaagagctgttccagacttttgggaccgaaataggcgaggttgccctaagtccttcgctcgattcaggaaccttcagagtggcagtttgcttgaatgataaagacgaaggaatgattgtttgggatcgacggaaaatggatggattccctgactctaaaatcctgaaacagcttattcgaaatattattgctcctttgaaagagttaggtcatgttgataaatcttccaagaacgatggaaaattgattgtcgacattggccagaaggaaacagatcctgatgcgtgtatagactgtgaaaagaagtaattgtgaaggatcagtcaatgccggcataatattcatccaaatatgataccaagaacgagctgatgaagaagatgaacatgaccctgatagataagggtactttgaatttgaactttggtagttggaagatggatgtgaatctacctgttaaccgtgatttatgttggtattttgagtttacgtttaatggaggtagattgaattttcgaaccaactgtgtctgtaataactcgatgcatctcgattgatcggtcacaagaacgtctaattgaccaaatcttgtttccaaagaccttttttctttatctttgtgatccaattcatatttgtaagccgttattaatcgatcgaagttctgaagtaattgctcatccaagtctttagattcgggtctaattcttctttggaattgttgaaccaacaacttatgggagttttccaagtaggctaaattattatgggaattaaactcttcaaatgggttctctatattgatggtagtgagggttggttcattggtttgcaggctatcgaccagtcttaaaacgaacttcttgaggtcaaacttattgattcgaaagtaaggatttttctctacaaaatcaaagatagcagaactcgtctgaggatccttaagaaggttaatccgggcctgttggttaatatcttggagaaactcgaagatggtcctgatgggcatctcattatcgttcaaaagacgcctttttttccaggcttcgtcaaaagcttgatctatctgacccagatcaaatagcactgacattgaaagttgcagctaggaattgtcacccagtaaccgttgttctagaggtttacaaagacttcttggttcagacaatctatcaagacgcgaccgcgactttctactctgattttgttattattattattattacctaagcatatggaggtttcacacctctgatatttgagtaccccaaggcattggggtttggacaccgacgtttcttgacaattttagtctggtaatcttcatttctaatgttgttaatggatgacagagtgacaacgttgtggttccatgaattgcgaagattagagtaattaatcaaagtctgacggtccatatctacctcgtcttcaaaaacaaaattgttggcaaagtcgtctcttcgttcagcttcagtgagagtcctcttgagactttggaatttagggactgttgagggttcctctgcgttctgctgactgtatctgttataaaagtcctcttcctgaggaagcaaggcaatattctggttccttttgagggtaattaggtcaagcttttgttctatttcaaattgtctcaagcttattatacgagatttcttgttccttaaggtgactaattctcttaggctgtgtccacccattctgtcattgtaatactgtttccattgtacatctctcaagattcgtttgctgttcaaaagttggttcatgatgaccgtgccatgcagatattctacttcaggcaaagttggtctttccaaatcttttgttttctctctactctttctggtaatatcttcgactttctgcttcacataattttctggaaaaaactttaatccgttaaatgctgtggatccaataagaaactcgttctgaccgggagcacaaataggaagtctcataagttttgtgttaagaataccaattgacgacacagatgaagaagaagtcgaaatgctgtttggaattttatggctctctacaaaactgcctgcagttgttcttctatggtggatatgatgagagtcgctgttagaatacacaggcaatcgagtcaagcaaccgatctgaatgccgtggcttcccactattccttgacctaacaacatcggaacttgttcgctagatagctcggagtctttttcacggttgatatggttgaatatggaagctcggtactcttccaggtcttgcgtcgatgacctttgaatgctattcgatgagtgggacaagatatccatctgataaagcctggtcaaatagttgactttggcctgagcttcagctcgggtttgagctcgggcttcagaagtattagtggatcgggtcacttcctgttcaaccatgtgctggaataaatggaaacaacttgctggtgtttcgaactccaggtttctccctgaaatattcgcgaaaggtattcatcatgagcctttcccttatcgcattggtgcctggtcccttttgatgccttgctacttcacaagtatgctgtgtctttgctcatccagtcaatacctaagcatttcaagactggtatgcctttttgaggtcttttggagcactgttgctctctcaaatatgaaagcttttggtctgaccgttacccagattcctctcagactggctcactccagagtagtattccgagttgacacctaataaagtacattcgcccgagttatttgatctagaacttcattgtctgtgtgaggtgtcattttcgacgtctgaaatctagttggtcttctgactaaccaaagcatttcaccttgtttcagatttcaaaccaacccaaaacaacgtggaaagttataaaatggaaactaaggagagaccttacctgttgaaacaaaactttaatgattattcaccccagagatatcactctgaatgtagacagttgtgtcggctcttgtacagatgatatcaccagtacaataaccaccaccatcacaattaccagattcaataaagcatacactgaaaaggatgcaatatccgctatcacaccgagccctaccgctccagttctggatattgtggtcgaaaaacgacagttcaagtccggttcttcccaaatgattacggatagctactccaaatcaaaaggtaccatggatgccagaacgagtactactcttgccatcgtcatcccgatatgtgtactcttgctggtgtcagcggttctaatgctgttctattacctgagaaggaaacaatccgaagattccataaatcctcaaatactcaaagaaatcagagagacaaagcccaccaccctgtatattaacaaacaccaaaggaccgatccagatcaaattaggttcaaggacattcctgcaaagaagatcgaggcggtatctggatttcaaaattggagaagacaatcaattttcaacgtcaaagactggttagataaacggatgagcagagatgtgagtatcagacatgttacgtcatcgtcaatcgaggaatcttccagcacttattccgaaaaggaccacagagattcagacagaggcgagactccccgaggttcctactctcaattctacaacaaagtaatcaataccccagccaccaacctaagaacgttcaagctcctcaacaaatcgccagtacatagcgggatacaccgatcacgtacccccgactcgtgcaatttccatccttcatttatcaaaaacatcctccggtcctcgcgcgactctacagatctaccccaacccactgttgtcaaggataaggacctgcctacgatacctctacacccaagcgatgctaacatccaacgtcaagttattgaagtcgacacaagttcgtcattgatttgcaaacccccaattgccaagatcaaacacgccgagcaaagctctaccaagaaagtcacccctctaagcctcaatggactggaaaagactgtaaacggcaccacgtccagtctgagggccatctaccaggtgattgaaaactacaaagcgaagctccctgacgaaatatccatagtcaagggcgaactgctcattttgaacggggtgtttgaagatgattggtgtaaggttaacaaagtaaacagtaggatggaaggaatggtgcccagatattgcatagccaggtttacataaacatgattttatgcaatttttcgtttggaatagtgggtgtgcattattccagctcagcccctggaaatcgctggggcaacaaagcatagtttagtatatgatgacataagacaacaataaccaacgacgataattgaatagtacacgtattatatatcaccccgacagattcttgaaagtaaactcctcaactcgaaacaatcagggaaaacaatacgaatttcgtctacactaaagactacagggatacaaactcgacaatagtcattccttacccaaccaatccccgttcttagcttgtgtttttttttttgttttcaattcacgtctttagtcgctagtcgttactgttttctcctgatatcatgaagagactattttctggtcagaaatcacggtcagcctcccccaatttacagagcagtgggacttttgagcccacccgggagaataacacacttgagtcccaaggacagatatccccagagttatccccaattttcacgctcgtcgctgctcaatcctatagacaatattatgagggcattttcatgctgctgcaagatttgaactctgatgggaaacctggcgaacgaaaatggaacgaggtttacggtgtgctcactggtacccaactcgccgtctgggatgctgaaaaactgtcagagtacaaagacgatccaagcaagctggctagtaccgcttctaagcccatgtatattaacttcacagatgcgactttcaaggctttggatactttaccgtctaccaacggacaattgcacaatgtaatagttctgtccaccactctaaaaaacagatatctcctccagttcaacgataaggagctgttcaaaagatggaatgctgccttcagactcaccaacttcgaatctacggccttgcaagaagcttacactgcagcaatactgtctagtcgtggctcaagactttctgatatcaaagttattctcgcagagactaaattcgaacatcaagattgggtcagtgttcgatttggaacaggtatgccgtggaagaaatgttttgctgttgttgaaccaccagctaagaaatccaaaaaagataaagtctacgtcggcagagtagttttttatgaaaatgagaaaaaatccaagaagggcatcatggcaactattacaagagcaacgtccatctacgctgcttatccgcaatctgccctcctggttgacagaagtaccttgatcaaactcgaaggaaccatcacgttttcaaaggaagatgatcctaaagatgcatcagtgttcttaatgccagaagaacattcgtctgtgcctggttatgatactctcatcagattcattgtgcccctaatggacgcctttaatctgtacggaagacccaagaggctcaatgctgacaagcgagagattgaatctcttttatttggtctacctgtactccccaaagtccactaccttgaaatcgatgacttgcttttactaaccggaagttccacaactaccaactggactttaaaagactggactatgggtataaagaaaattcttctgaacaaaatgcagtccggctacactggctgcggttctgctcatggaataactggcgctgtaagttcattgaataaagacaactccagcagggctagctctccgcgtattgctccgagtagaggcaggggtacttcatcgatctctccagcacctcaaatgcttaaatcgacttcgcaaaattccctgggaagtgaaaagtacttgaagccctcaattgaactgaaatatggtgagagcaaagactcgattccatcagaggtttcacgagaagatgaccggagcccaggggcagattctacgagactaagtgaagtttatagaaaatactctgagatccaagctccttcttcagattatgttggtccagaatttttaactgctgatatgaatgatatgtcattaggccctcgtggtccgtatgagatgaatcaacgaattctgagtccctactcagagtttagaaaaaataacgcttcaaacagtgattctcttatttcctctacttccactagaactgcaatcatcgctgaagactttgatgttttcaaggctcctcctacggccaacgtttttgacccaacttatgacggatacgataatgatgaagatgaaggtaaggagcttccgaagattacacaaactgaccacagtggatacgatgcgcctttacgaaccccagaccaacccacatttggctctgaagacaagttctctccattgaccgcgttcaaacagcagttgaacagctctcttgctccagtgcagaaaaccaccagtaacagtagtaacagtggtccaggaagattgtccacggcgtcatctttctatccaactagcaacgagtctttacctcagcagacgaacagaaggggtcctaaagataatgttgaaaacagggatccttacagacagggttcccctcaagtgcaagcacctcgtgagagtaatggatttgccgaccagttctacaaacgacaacagtacccccagcaaccgattcaagctgaccaccgttctcgtccacaggagcaacaggataaacgctggcagcagccgcaagattacaatgcgcaacccccacacattgcaaagaactatcaacccagaagtcaccctcaatcacctcaacaacataatacctatccccagcaacaacagtcgctttattcttcacaacagccgcagcaacagcagccacagcctcaacagtatcaatatcaataccaatatcaggctcaaccaaggcattttcaacagcaaggtcctgcgtaccgagcacaggggccgcatggtccaggtcatccagagcagacacagcaagggtatccaaccccccaccgcaagcctgctccgcctaacacccatactaatgcttcaagtactacgagatctgacgatccttacgctactgctaggaggcaacaaccaaattaatctgaatacctatttggttactaatagctggaattgtctacttttttaagaaaacctgtaactttattgatatccatgtcttcaggctcactttccactgcttgtacaagactatcaagtaattcatcaacttttttctcgtcaacactcgtacagagggcaacaacccgcttgaacttgctctggagaatggaggactttgacttcaagttttcaagaatttctaccagctttgcctcgttttcctggtatgcttcaatacgagcattgagtactactgacggaggcagctcctgtagattaaaattcttggcaactaaaacttgataaatttcttctttgtcgatgttgtctttgagattagctagtacctcttctcttttgtcctctggcaaactagcaatcttcgcctcaatagcattgtatactggcaagacagtaaaaggttcatcagcatcaaaatctccgacaaaacttgtaaggtttggcagctcttgagcattaatcttgaaggagttttcttcatcattgattgatttctctatattggccagtttagacttcaattccaaaaacgtggcttcagtatcttgtaaatggtataattgggatctagccttcgataacctttgcgtagaactgcgcaaggtttcctggagggattctatattctttgtcttggagttcaactcctggttgaaactcgttgacagcgctgataacatagtctgtaaatcgttgacaatcttcgagctattctgctttggagcagaaaaggaaggggcgctagaaaatgatgctgggggtaaagaggactcttttgctaacgatatcccattgatatttatcccaaaatccaaaggtctcaagccagctttgtttggaacattgggattagctcctagatccagtaattgttgtacaacagttttgtttccaatacgagcagcaatatttagacaagtgtcaccgttcttatcttgaacattcaacacttggctcatgaactttccaagtggcaagttctgctggccaggcaagagagcacccttcctcacgatccattctagcaaagtgcttaaatagtacttggaagcagaactacgtcctttaataccagatgttaaagcgatgtggtgtaaaatcgttcgtccctgataatcaaatatggtgatcgcagggtataggagatccagtatctctgaaaagttccctgcgtcaaaactattagtaaccagtatcgagtgtactaaggcagtctctccctcgacattgcctctcagcctgttagccttatgtttgactagctccctgatgagataggttcttcccagagttgcagcccagtggagagcagtttgacccaaatcatcaaatggaacatctatacaaagctcgtccaaataatgtggatcgttacccactatgtctatcaaggatacttcagtatccttcgaaagaaatattgacattataacactcttagatttttgcaagtcgtaacctctgggattattagtctctgagattggcttgagtgcgtatggagcatcagggttaggggcattgatatcaaacgtaaactgagcaccttccggtaaactggacggatctatgttagtttttgcgcgtttcactggagttgttaagctctgatctgccaagtccattgacacgtcgtgaacattatcattctcggttaaagtcgagaatgccctggtcatgacggggctgttagtattattgttattaatgttgcttgaggtattatcagtgccgccattgaagactgctgtatagaagcttggttggtcagattgatttgaagctgtagccacctgtggaatatctttagacagttccgtttcaatcttattcagcaatggatctatgatgtcgtcaactctgaacgattttgaaagttccagacaacgatctttgccgatccatttacctcgtaacagttcattttctgtgtccacagtttcaaacggaccagtttcgatcactgccctaatctgttcgcccaagtttttgccagttgacccatgcaatttaaccagcttgctgaaagagctaactttgagggacaatggttcgctaacgtataaacgaagagaagggtcaagtgtgacttcaaaaaacttccctgaattatcaggaatacgggttatactggtgatttgaagcggttgtgtggattggtcgttggtggtcattttgtagttttacggtgagggattagccctaattttcttcctgtaagtgagctaaagcttcctttcaatttgttcacacaatatggtcagcaagagaaagatatttgatggagagtgcgtttacctgcaaaggcgtggtgtgatagaagacgtgtgaggtcgtttcaagcgttcctcaataatggaaacacataaaattcaatttagcgaatattagagctatcaatccaagagggtttagtctactccccccccccccccccccactcccttccaagtccaacttcccacctactctcaagatcattgccttttcacaccaatgtcagaaattcctgaaatcccggaatcgatttccaaactagtgggtcctctgctgaaacgggcgtctgaagtgaaacttgtggaccctgctgtggcttatttttgtctactccatgccgctgaatctatactaaataaaggattgcaccaaacatccgatgaagtggccaagttcgccatgacgttgttggatctggttgaaaaaacgaagtccgaggcttcggaagatcttttggaactgttcaataaccaagaagcaggattcctacacacagaacagtttgctgtggctgtcttcaacaaggcattcttggacgtgcgaaataagacaaccaccaaggctactatagataaattcagggcaagcttggtgtttttcgatttgttgaatctttgggattttcccttatctgatgaaactcttatgaaggttaaatatgccaaatatcatgctgcaagaatcttgagagcttataaagccggtcaggatcctaatgattacgtgctagactcccaatccaatgatgatattcaagaggagtcaattgataccactaatcagaacaaccagactaaagaagataccaagcctgtgttgtccatcagttctccggagcattctcccgatctccaaggaaaatctccttccccagatttaccatctcctccaaagtttataaaagacaaccagaacattgttggtgactcagcccttccttcggctcctacttttatcaaaggcgatgacgcaatgtttcccaagacaccatcgtttattgatgattccaacaactcgaaaaagacagaaaacattcctgaagaggctcgagccccttcagccccaataatccctaaatctcccactgcagttaaacctatgtccagtccggcttttcctaaaacaaagaaacagtctcatttgggtgcacaagatataaaggaaatactagacaccgaggaatccataaccaaagctcaaaaacacgccaagtatgccatatcagcattgaactacgaggatatttccactgcaactaaagaactagagcttgctctgaagcttctaaagtcgcttagtcaataagtgcatttattatattagtcggtcattatattgattcttctctagcatcttcgtaattttctgattgtggagtttccgtgagttggtgatcactatcaagagtaaaagtcgacgatgacattttcaacttaccttgaccatcatctggtacctctgattcgaccaacgatactgcgctgctgtgcctactgttgtctttgagaggactaatgttctgcagagagctctttgaatcgtttgaattgccttctctttcctcctgtaaacggcgtgatctttgcatcttcctgtattcctgagcggatgtatgtccagaccctttggttttctccgttgtagcatcagagtccgaacgaatgcctttcaataatgacatagctcgagattcaatgtcgtctccctcactgttgtcgtgtacggcatcagcattttcaattgaatcgttaagggcgtcttcaccgtcataaggtattcctagagaagccgaagataaagaaactgagttgacattcttccttgtctcagcaagattccttcttgctaatgctcttcttctagctgattgagggtctccccttgtaggaccaacggctttaagctttttcagcaagtcatctaccacattatccgaaactggacttgccgcgtcatcagacacagcagctacgacttcacttttctttggtgtttccattaatttctttctctgctcatacagtctctgctcttcctctctttgaatgttctctctagaagctctttggaaatctgaaacaaaatcggcaaacttcttgaaaaatgagttctttgcaaattggtctgtggcatcttctccaaaaaaactcataagtttttcaaagttatcgatcacaattacaagttgatcatccagcagattactcttccttcttgctgttggcattctagggagaactttgacaagaacccggtcttcgggatgaaattttgatgactcgcttagatttccaacctctagagaggcatccacattcttgatactattaatatactctttacactcttgttgaatttgttccacaggtattttagatgcatcaacacatggcttgagctcgtctataaatgctgtaagttcaggatacgaggttcgaacaactttctccacatagtgaagaaatgtcattgagtttttgtcgtctttcatgaatgaaagcctttgcaaagtgttcaatttgaaaccttgagcttgctttgaagtgtcattcatgtagttacccacagcaagaataatgtccaaaatttgctttaaataggtggaattagtcagcgcatcggtggcagcctcaatcagattcaacttctgaacgagatcctgataatctttctcgtatgtggttattacgttcagagctcggattctagacttccaataatgctgtagattgtaaaccaattccaaatagactctatcagctcgtttcagttcgtttgcatctttttcaggttgctttctctcgccagttgtccaatccgtgctatacggctccaaattacgggccaatgtggtaggaatttccactaactcctgacctcccaagaattcaagtacgtgcgaattttgcataacatcgtgatcacatcgaagaagttttagcactagttcttcgtcacttaggttgttgaaaacatgtagattaatttcgaatcgatgataaatatccctttgaaggaaagttatcttgtcagcatcgtttttctttcgtccggtgagtttctttatttctctagcggcgaaaatgttttcaacttcatcaaatacacctttggctaaaagctccttcacaaattccgaatagccagtattttcccaaaaggaaccattggtatcatcaattttttcccaatgtagctgtttaagtttctttgtgggtctagggatatcagcaaagggtgaagatggtaaaaatggtgagggtaccggagaaggggagtcccctttcatcaataaaggaggcgccatgggaggcggtggaggtgctagtggaactgatcctttaatatccggaagagggggtggtggtggtggaggagctgccccacctgcgatgttggaaggaagaggagggggagaggggggtggaggcgctttatcggcgaccaatggacctttcttcttcggactagcaactttttcgtcttccgataagatgatacttttgtcagtagcattcagctcttctgatggtgggtgagatattgaagttggagcactattaacatctttgtgttcccttttagtctctattattgcatcagaatcatcattttctgatgatgaatgggactgatcagtacttctcttcaaattcttgtgtcttcgcattttgtgattaacttccaaattaaagttggatgcatagtcagagtcagaatcaggatcttcaattgttgacgttttagcaactttggaagatagttctgagagaaatttgggattcatgcccttagacttgatggtttcaacagttgttggagcattagaatttacctccaaatccatagacgaagcttgctttactttaccactggtgtatttggcctcgatctccgaataatccagtctataacttcctcttctagagcttggagttgaactataaatactggccaaatcagagcgcctcctggatagacgtttcttattatccgtaagatcaagcttgttagaaagctcagagcttatattttcgacttcatccatcgttcggatcaaacgttcattgaacttagggtccattgtgtaaccttcggactcactatctggaggtaatgaaaaatcgatattgagatctttgaactgtttttggagggtctgtaatctttccatagctagcatcttttccttcttataaagatctttctgtgacaaatcagcttgatacttcattacatcattcgagtccttttgaagcaggtataatttctgacgtagttgttctaacttctcaagatcatcaagttttggaggtcgggatggtggtaagggcgatccctgtttttgatcattgtccaaaaattctgtcatttcaagctccttggcctctctttcaatgtcttccatttgatttcgaaggcttcttaactttttactaggttccacaataccaccgtattttctggattctgttttgtattcaatttgtttcttttccaattgctgtaataagcggctctttagtctatcatccttagccccaactggctcagtattgctatgctcaagggcttgtttttctttcaaactgttaagagtaatcaaaagttctcttatttccaactcctgttcttgcttctcaaccattctgagtcgcctagcctctcttagatcactcattatttgctcgttctgccgcctttgcttactcaatatgacttcttgttccagtaactcctgtttaagctgatctacaagcccgtcactacccatgctcatctgtcggatgagttcatctctttccgcaatggcttcttcagctttcttcgtagcctctcttgcttccataatggctttgcgggctacatcatcagtttggagagaagagaacaaccgattaattgttatattgagtgcagtttcgtcatttgaggcagctgcagcagccatggaaacatttgaaaccaagcgatcaattagcttgagtgttctattcaagcctttgcctgtatccgctttttcagagtcgagctggttcatgaataggttttgcatcatagatttgatataacgttgagtctcactatcttgatttttctcccaaatgacctttacaagagacacaggatcgttcagatcaacgttcttgtcttctaacgtatctaattgcaataattgttgatggtcttgagcttcataatcaaaaaacttttcaatttgatcgttaattatttcattaccaaagtctctcaaataatcgaatatgtctaataaatgtgcgtttttgaaagaatttctagtattcattctttttcgtatatccggctccaactggattaaagaattgatcaatatcatggaagatacaaagaattctacaacggagttttcactcgaattagatagctctttatactcttcagatgcaccaactttggaacccatcttacctctaccttctaaagttcttaggatggaataaagaaatccttcgtacctcattttgctgtagtctgatagagttaggtctatataactggaatcagacgatgtagttgattgtgcactcgaagtaacctttttcttcgagttcctttgtagctgcgcttggtgctttaaatgaaagttatttccgatcctttgcgtgaatgcttcccagacttgttcatagccagaaatgtatccatattctgtgttcaatcgccaatttgaaagaaaggcaagcatatctgctgcaagcttcttattggcggctcttgtagagaacagtgcaccaaacacagtagaagaaaagatttttgattctatggcagctctgcctcctatatcagatgcattcagtgatgcccttagacatcgcaggagtatagactctttctctaacaatgaattatattcctcagtggcattagtgaacattacaggcgtactcttgctggacattaaaggagaagtcttgtatagctggccaagaacgttccccaatgcgaccataccttgagctttgagaaattttttcacccattgcataggttctgttcttaaagaaacccacaaattgctcagttcattgacatgaatggtgttggaaatgatcttacgaacgtaatactccggagtcaaaagtataccatctttgtccaactcgggagtaactaatgttattggatttatagcgctggtggggttctttagagctaactgctgttcatagtattgtttttggtgcgtttgatacctctggtttttcttgtattctgcgatctgatcttgagcaaccagtgtccattttttatcaacactataatctgccaattcctgacgggcacttgaaggcagattcttgaaatctctctggtccatcaatatgctaaacagtctttcaacctcggtgtcagagggacgttccggttggtaagaatccttagacggagctgcccaatttttcgtaccagaggagtaacgtgttgaggatgtattggcggaataaaccgagtctgtgttagtatgtacagagcgtaggtcactatcatacattccagagaggatggaattctttcgggaaaaatcattggtgggggttctctggtgggacaattgagacatggaattggcagtggaaaatgatgacgcaacaccacccttacctgtaagctttggatcaggattagggtcggctttggacttcatcttcatccagccaaaacgctttgtagtagattcgttcgacatgtgtacacaagatgattcacgtgaaataggccaatagtaagtaaactgaaccttcccagtgttggacgaatcttctttccagtagtagaagacttggattgaatagcgttttgctatgagttgtgcgttattcctgtgatgctgaacgtattcaatctaaggttagattctgtctgtgagaaagatggaactggaacaatgtggtgtagaggtgtatattttagttgggagaaaggttgggaaaaataaggtgggagaataaaagttggcgagacttgagttgttagatgaagggtaaagtgacctttgatatgcttgtgatcaattggtctttgtagtacatatcggaatacggacggggtttttcattcgaaaagtctctcaaaccggcaagcacgtcaaacctaccagaatcttaattacataatacggctacatgaagtaccgagcctggcagattaaacattttcgcgacctcacgttatagataagatgggtcaaggggaagtcaagtcttccttcttctcacaatctaataccgttcgattctctttttttttatcaccagtaaagcaggtctttattctctaggagatttggagactttgttttgcactcttgggtttttgcaaaaatcgggttaagagaactccacatttgtaagcgagatgaacgtattgaagaggatgactcggaagatccgagatggcacagatcacggccttttccacaaactacgaagtaaattcaggcggaatcacgtaggttccgaatttaacaccagcaatggactttacagcccggatttcagattgttcagtccaagtgatcccaacgaacggatggctcctaattataccgctcaaacatctcaaatggaaaccgaaaattctggacagaatagagccgatgagatgagagagcagttgccaccctcaattgtagcccaactgagtgcattgtcggggcttctagatcaagttattatgactaccgtgtctgatctgatttctagaagcagaccggcccagctagagcctgatatcaacttggatgaagaggacttgatggatcaaaactctctggcgtacggtattcaaatgtcaactaatacaggtttaaatttacctgtctcggagaatatgagtttcggacaattcatccacaacttgagaaatgatgagtatcttctgtcgcaattgggtgagcttatagtacaacaaagagaagccattgtgcaaggaacgttcaatgctgaagcagatagggacagtgtcaactttctcactgccttcagcttcaacaatgccacccggtacactttaggggcaggaggtttacaacgattgaccccaattttgatcgtgggtttagttagtgttccattttttgaaaacggcacgtttgaagagaccaatagatcgtgggttgtcattgtaatgtctaatatctatcctgccaatgacgctgttataagatcaatgcccacattcttggatcttttgagaagttatgctgccgctacgtctactggggaatcgtctagcaatcgaaacgttgttaacatctcggtaggactttctggagagagtggagattctgactggaatagtgaacattcaagacgccaaattgccaggttttttgaggccatgattccttccaaaggaattaagaaggaagatttagacaaagatacacaaggggtatttcgcatctcgataccggttactgatgacgataattctttttactctactaaatctcattttgaagaaacaaccacaccgtttccaactaaaaccgtgcaacatgacgatagttgtccgatctgtttgattaattataagaatggtgactatgggcgtgccctagttgattgcaagcaccaatttcacagagaatgcatagatcaatggttgattcagggtgaaaatgtctgtcctctttgtcgaggaaatggaattgtgatatccaaaacgtgaataaattgatatttaatgagaggggatgaaataagtaaagaatgggaattggtgggtattattggttttattagttgaatatttctccgtagtctaacaggtcttctactctgcctgaggtagtactacgagatggtttattttggttttccggttcaggtattagggactcagaatcatattgtgattcagaagtgaaatcgaggtcattaaactcttcgggttcaatttcatggagaatgttggtcgaaggaaggggcagtggaggatttgagtcaggggaaacatcagaatcttctaagaggtttttgttcattttctccacgttgttgagattactatccgtgatcaagccttgtaaaccacgttgctgctgttgctcttccaaacgcttcattttcttcctccgttgatatttctccctcctcttttcactcttgaatatctcatagtttctgtattttgccagataaatcttcagagttgcggcataattttcgaaccccagtgtgttcatggctaggagaatatcctctccgttcaaagtttttctcttctccagcgtacatttttccgctgcttgtgatgttatgaaggatatgaactcacttacacattcttgcatgcattctttagcctctttggatagttttccatatggagggagtgctgctctcattacttttccaacattagcaattggaagccaacgatcctgttcccttacgtatatgtcgtcattgttcattctcagttggaaccaagagcgcaagtgactggctgatctagggctggactgcgaacggggggacggaattagaagattgaggcttctggaaacgagtctatatgttgaagtgtccttgatttcgaagatctgtggatcatcaagcgttgaggaagaaaaaaagaaagaaagacaagagtttttttgttacaggggcatagctcatcactttaatgcaagctgctgtggtcagactgattaacaccgaactgatcctaggattaggcgttagaagtcacgtgcagattatgtttaggaatgttttctgccttgcaggggtgctcaaattggattgtagattatgtaatacaggttatttatatggttttcttttttgaggaatttgttcaattgccaggtagttggaaggaattgagaccaggtaaaattggagctcaaaattccactgggctagtactattctcctctgctgttaatctcattgaccttgtcaactcatagccctctccttttaaaggtttattctttgattggtacacgtcttattcttgattcacatatctctggtccatggtctatatttcaagcgcttgactttgcctctgccttcaactccgccaagcaatggagggcgatgacacggtactttccaacttggttcagtctcaggatgatagctccaaagttcagaccggcgaagaatcccaggagctggactcacgagcgatgtcttcatcttttcaaagtctggatctaatcaaccagaagttactggcccacgctgaattgtgtttggaatccgcccatttactaaccagagatgccataaacaattcaaccatactctctgaatatcacaatcttgttcaggcagcattgcactttctcatttgcattacaaaatcatcaggtgagcctttatcggtcattgataaagctcagctgttttacaagatttccgtcattttacaggaggaaacagaagaggtggaccttgctatacaatttctgaacaaggcagatgctctcgtaagccgtgatggtcttttagaatacatgtttcagtacgaatcggccatttgttctttattagctagagaaggaactcagcctaagatgatctctaatttccatgacaattgcataagaaaatttgaaaatacgaattcctcattgtttatctattatttcaagttcctgaaagctttcaatgttacgcttctggataaagaagatgcgtatagagcactggatacacttacagagttgagtctggcagcacttcaatcaggaaaaccaattgcaacatcaccactcttacagctaatgataacaaaaaccttaaatattctactttactgtggaagatataaatcgtttgaaaatctgtaccaattgttgtgggaacatgttactccccaggatatgccagtacagatacatggtgcattgctactacactctttaatatttcacacaattaatcaaagtgactgggcaacaatcaaatccaagatggtgttattaaaggagtttctaaaaaaggatactgctcattggacgcaatcatttgttgtccatattcaagaaacgtcaagtaatgttccagtgacaataacctgggcttcgcttagtcgattcaaactactcatttatttttattctgcgctggcttatttgcacagatcggcggatggtaacgatagagcgattaagctcctaaaatcatgtgaaatgctcatctccaacgaaatagccaaacttgaaagtaaagacagtaaggtggtgttatccttcgaacaactgcaatcccaaaaaatgtggctgaactacctttcaatggctacaaaaatttatcagctatatgaaacatttattaatgctaatggcgtgctcaatagtaaattgccaacagattggcttaccgagtcagaagatttgccttcaccattgaaagaattgcgagagttcattgccgattatgatgccggcaaagtgtcttcgcaagagctggtttactatcatagactacttcccaaaatatacctcattctagcgttccacttccaagcaaagggaaaacttctcagagcgaagtatttttacgatagaatattacatctcttttccaggaaacctcatgatctaaatgatgagaacttttttgagcaaccaagagctgtttcctacgcccaaatgatctctggcattggaggaataatatacgaaccaaaagaagaacaaaatcagctatactgcattgcactgttgaattaccataaactgaacctttacgacgttaataagcttaaaagtgatatctcagggttttcagaagaacattcgaaagatcgagatttctccaagaaactggctagaaaaaaaagaatgcagatgaatgtcgtccaaacacaatcacaactagacatttccttagccaagatcataaattctctagagacccaacctcatatcctattggcatctcgcctgatttctcagttagcaaatttgtctcaaggatcagaagttgacgcgttctcctatgaagaacctccggaacaacacctttactggtcaccaattctcaagaatatagctgtttttttgaaggcagattccgtatcatattcaaaagaagctggcgaagaagcttttgtgaaagaaaagatcaaactttataagcaatgtttgagtttaggagatagagcgtttagcctggacccattggttttgaccagaataattcaattaaaggaacaatttccaatttacttttcagaacaggaaattcaacaagacaaagtgaccttgagtaatcttacctcgtcgtcaaaacgtactcatgatgcggatgtcgataacgctggacttgaacatgaacttgaagacatcaaacccatagataatactccgtccaagcgagctagaaatgaataaataaaagcaacttttctattatttatactatacaaagcgagaatacagctcatccctagcttctatttcaagctctccaaaaagtctttcttgtttcagagcaactgcatcacttgaggctaaaaccaatagctcaaaaaatgctcttgtagcttttcttttggaattggtagagctggatgaatccaattccaagtcttttgacactagttgagaaaaagttatagtttttgactcagtcattgtctctccaaggccttcctttaggtaggacacaatcttataagtagattcagaaaccacaccgttgttgaattcagaagtggcgttctcttcttcatcattgagaatgtttccatcttgggaaccatattgaaaggaaggaatggatccctcaaactgttcatcttgatcatcaaagtctagaccggattggtctccaaaaccaaaacttatatcctgttcttgaggaggctcatcaaagtccacattaaaatcattagcatcatccccttgttgtgtgggttcgttcagatcaacgtctacgtcgggctccatgcttttttctttatcttcgttcaacttccttcgtttgaagtcgttctctaaaataccaaagagagtgggcttcataatgccctcgttgctggattgtaaaagtatctgaagtttagtagcatcatcgagttgcgcttcatgctgggttaatgcttcttcatcgtcagtggatgctgggggcgtctttagttgtttctttattacatcgctgggaatctcggtaactgtgtctatgataatttttctcttggtggttctaaccacatctgagtcttgaaatttttcccagagggaggttcgtcgtttttgtgggctgacggtttgtggttggtgaatttctgggatgtcagtgtcttgtggagttgacgcctcgttaacttcgtcctcctctgcaaacggagttagggggcccatatcaaaatcaaaaggttcatcctgagcattttctgccggaaggttttcaaacgttaattcaggcaaagcggtggagtcctgtgctaggatattatcgtcgtctctgcctatttctattgattgatcaacgtctaagtcatgatcaccttgatcattatcgcccaagtcgaagtctaagtccaacgttgcttccgctgggttattttctagatcatctacctcgtggcctcttccgatttctattgaagtattattgccaacctcctcctctggagcctcttgagagcctaataggtcgtcaaaattcaacggttcttgatagagcaactcagtttctgttaccgtgtcgcgtaaagcaatcgcattgatcgatgaaagcactgttttttctgccggtaaagtaacagaattactacttctaaaggcggttttgatcctcaacagggcctcattgacatcatctagcaagtatttggcctttctagagtatattctaaccactccataaagcagctggccagtcaatctcaatgccagtggctctagcgctgtctgagacgcggtttggtctttctctacggtgccttgatcaattgaagacgactctcgtattgcctcggttgactcaggaatagaagttttcagtaactgagccttggtcagctttttttccaaatttgctgccagccatacttgagccaatggaccttcttttgtcagtaactggtcatgatataacatgatcgtgccagaagagttttttgggcggttgagtttaaataccgatggcaagagtagttgtttacgtgagtacgtttagcaaaaagcgcgttttccttagactcgcgtcgcttacaattttttagtagggagcaaaattccgtgcttatgtaataatttctactccgagggtcgatgaatatcctgatatgtggggtccaaacataatctcccaatccaagtgaagtcagttggttcgacaggaccaccgtactggtggagtgcatgcgccatatcaatcccagtttgttggagtgcaactctgtgtgcaactacatgtcatgattcggataagacatgagatgatccattttctttattgcgagcgggattactccaaacttttcacttcaaagactcttgcaaaggctctgtattttcaacaagttccatccttattgcacgcctcgtgaacgcacgttatcaggaatacacaaaccaaaaggtcacattactctgttctcagagtatgagatttgcagcacctcatctaccatagggggcgactttgtcccgtatgaaatctgcaatcttctcccaatattcttcttgtattactgtgtcattgtgagtagaattaggaaactcatgccactctttgtattcacttttgctcaactgatgtaacgacgtaatatgagctggaggaacaatttcatcctttttagcactcatgaaacacatgggaatattgctaggaatcttaacgatagcagattcagaatcccatatctgatggcacataaaagacacaggtcctagtagcggtaaaatatagggaataaccttgcggatgctcaagaatgtgttttccaatattattccatggacatgagagggatagttggaggctatgtaaatggctactgcacctccaagagatcttccatacagaatcagtgatgatttagaaagctgctcgtcctcagaaatgtactttatgactgtatcagcatcaatcttgaggcccttctctgaagccttgcctgtagaatgaccgtaacccctgtacgagtaaataacgacattgcagttcatctgagcatagaacaatttgacaatggacagatagtgaccgatattgccagcattaggacataacactaaaactgttttattggagtagttaggagctttgggattctgacgaacgacgaatgcctttaacgtttcgccgtccaatgtctcaaggtctatggcctcataatcatgcatcccatacagatctggggtatcgactgtgccatgaccatcattcagtccagcaggataaataatatgtgattggaagtggtagattccaagcaacagaagggtggaaaaccctcccaaaatcaaggttgacatcttggcagctttcaccaggaaagggaaccaggattgtagcttgaatagtaacacagatgatgaataggctgttgtctggataacaattttatccgtctcctgatctgacattagaagactagatagaatcgctagaaaggtaagtgcactaaagtgacccgaaaaggtaaaacaacccggaggacccttttggcttggtagtgtaaggttggtgtattcaaataaaagtatacctgtggcggcggctggggaaaaccttctctctctcgagccgagcggagattaagtggaaaggtctgtaccattcgcgaaaggagcatgctcacccaatacaatcaactaaacagcatcaatatgcatctgcaggagttattcgagatctgggtgatgccctttggaacggtattctgtttggttcaattcatgctttaagaaaagcaaattcaatctgaaccagcccctcaaactagttgagcaattggcttcgtgaatcatgacctatggacttctatggatcccaaaagagagatatgagacgagaacgagaaaggggtattaatcacgaaacaacgtttcagacgcgtttacatgatgattgcatgcagccctctttcttattgtcaagctctgcaattggtctaatcaaagaatggaacgataatctacaggtatataaccgttcttggtttccggtactctgtcgattgcaaccttcaattaccatcttcgaaaaatgagcaccctgacattgctggctgtgctgttgtcgcttcaaaattcagctcttgctgctcaagctgaaactgcatccctatatcaccaatgtggtggtgcaaactgggagggagcaacccagtgtatttctggtgcctactgtcaatcgcagaacccatactactatcaatgtgttgctacttcttggggttactacactaacacctcaatctcttcgacggccacccttccttcttcttctactactgtctctccaaccagcagtgtggtgcccactggcttggtgtccccattgtatgggcaatgtgggggacagaattggaatggagccacatcttgtgctcagggaagctactgcaagtatatgaacaattattacttccaatgtgttcctgaagctgatggaaaccctgcagaaattagcactttttccgagaatggagagattatcgttactgcaatcgaagctcctacatgggctcaatgtggtggtcatggctactacggcccaactaaatgtcaagtgggaacatcatgccgtgaattaaacgcttggtattatcagtgtatcccagacgatcacaccgatgcctctactaccactttggatcctacttccagttttgtgagtacgacatcattatcgactcttccagcttcttcagaaacgacaattgtaactcctacctcaattgctgctgagcaagtacctctttggggacaatgtggaggaattggttacactggctctacgatttgtgagcagggatcgtgtgtttacttgaacgattggtactatcagtgtctaataagtgatcaaggtacagcatcaactaccagtgcaacgactagtataacttccttcaatgtttcatcgtcgtcagaaacgacggtaatagcccctacctcaatttctactgaggatgtcccactttggggccaatgtggaggaattggatataccggttcgaccacttgtagccagggatcatgcgtttacttaaatgactggtattttcaatgtttaccagaggaggaaacgacttcatcaacttcgtcatcttcctcatcttcctcatcttccacatcttccgcatcttccacatcttccacatcatccacatcctccacatcctccacatcttcctcaacaagtagctcatccattccgacttctacaagctcatcgggagactttgagacaatccccaacggtttctcgggaactggaagaaccacgagatattgggattgttgtaagccaagctgctcatggcctgggaaatccaacagcgtaacaggaccagtgagatcttgtggtgtttctggcaacgtcctggacgccaacgcccaaagtggatgtattggtggtgaagctttcacttgtgatgagcaacaaccttggtccatcaatgacgacctagcctatggttttgccgcagcaagcctagctggtggatctgaggattcctcttgctgcacctgtatgaagctgacattcacctcatcttccattgctggaaagacaatgatcgttcaactgaccaatactggagctgatcttggatcgaatcactttgacattgctcttcctggtggagggcttggaatcttcaccgaaggatgctctagtcaatttggaagcggttaccaatggggtaaccagtatggtggtatctcttcgcttgctgagtgtgatggcctaccatcagaactgcagccaggctgtcagtttagatttggctggtttgagaacgctgataacccttcagtggagtttgaacaggtttcatgtcctccggaaatcacttctatcaccggctgtgctcgtacggacgaataaattcagatatatatacaagtattcttctatgtactgatgttagaattactactaaacccacgttttttgttcagctttacgtctctctaatctacgtttgtatttcataccacggtgttctacaagtatatcatcagctttgctgacagcttcctgaatggctgcctttctagcttcaagggttctttcccaaatgtgaccttttggattgaccactccacgcaaaggcttcttgttatcatatttctcctggaaaaacattttcccattgttgagcgtgggtagcagatcagacacgccaaacttgtaggccagtttgtataaatctgactgtctgcgcatagaataaatggggttatgagttttgttggtcactgggtgaatatttggaagaaatggattggcatcatcagcagtcgtggaagtgggggtggaagcatactttttgaatggagcaggtggataccttgtgaagaagttttgcaacttctgaggcaactttttgaaggcctgttgtgcggttaacgacattccaataattaatgaagtgaactgaaatggttcagatttgttaggacatcagactgaaagatttcggtcgcgctccatctaagaactcccttctattaccatttttggtttttctcaagaattagattgaccgtatcagtgactctaatattatctagtccccatttctttttattgaaaaaaaaactattagtcgtaagagtcttcttcttgcaacaacaaatgaagtgcagtctcagactaactacgcttagcgtagccaagtccactcgaatggcccagagatcagtagtctgtaaatactccactcaacccaataagcaggaggagtttgttaaggagagagaaaactacactgtgacgacctattcaagaccaaacctggtgttcgaaaagggacaaggttcctacctgtgggatatcgaggggggaaagtacattgactttactgctgggattgctgtcaccgccttgggtcatgccaacccaaagatcgctgagatcctttatgaccaagccaagaaagtgattcatacctccaacttgtatcacaacctttggacctcagaattgagcaaacagttggtagagaagacaaaagagagtggagggatgaaggatgcctcaagggttttcttgggtaactctggcacagaagccaatgaagctgcgctcaaatttgctcgcaagtacggtaagtctatcgcagaggataagatcgagttcattactttcgaaacctcatttcatggaagaagtatgggtgctctttctgtgacccctaataaaaagtatcaagctccttttgcacctctgattcctggtgtcaaggtagctaaacctaatgacattcattctgtagaaaagctcatcagtgataagacatgcggtgttattttggaaccaattcaaggtgagggtggtgttagacctatggaagctaaatttttggcaaaggttcgtcaactatgtgacgagcacaatgctttgttaatctacgatgaaattcaatgtggactgggtagaactggaaacttgtgggctcactgtaaacttggtgaagagacccacccagacattcttactatggcaaaagctctaggtaatggatacccgattggtgctaccatgatcacagaaaaggtggagagcgtattgaaagtcggcgaccacggtaccacgtatggtggtaatcctttaggagcccgtgtgggaagctacgttttgcagcaagtttctgataaggatttcctaagtaaggtcgaacaaaagtcagaaatattcaaagtcaagttgtctgaactgcaagaaaagtttcctgatcttatcaccgatgttcgaggagatggtttactgttggggattgagtttaatattgatcctgcccccatctgtgccatcgccagggaaaaaggactactaatcattacagcgggcggaaatgttattcgtttcgttccagccttgaacatcgaaagtaaagtcatctatgaaggcttagctattcttgaggaggctgtcaaagagtttgctgaaaatcagtagaatgcaatttgaatttataaactaatactattatttcttaataattattccaacctgagctcatctattctatcagcgaggaagaaacctatcataactgtcaaatatatcaggattaacatggcacctttgaagtaattggactttccttccgcataaatatatgtaaacataaatgccgaggtgaagcatgcaatgatgtcccatctggggaatactagggtgaacatggatgaaatggaactcgttggcgtgaagtgtatgatagtatagattaccagggctgggatttgcagtaaacacacctgcagagcataagcagatccgatttccattgacaaggcaacatttccgttcaaggcaaacgatatggcattcacaaactcggtggtattaggaactaaagcaaacacagtcaaacccaataactttggactgatgggaaacttgacgagaataacatcaacagtgtcaaccagtatttctgcaatgacagcatagagaagggtggcagataaaaggatcacagttgatttggttctggaccagtttggtgcatcgtgcccaccgctatcagcctctgagttaggctgaactgaagatggctccttcttcgtttgttcctgagcggccttggcaacattagggagtgagcttcggtgatgtgaaatggaattattttttgctggcgcattgctaccttcaaccttcggtctttcgtaaacagttggagtgctccaaatcaaagccgcatgagtcttcaatgtggataataatccaatcgaataagcaaaaaataatgcaatagcacatatcagagaaaatggtttgatatatgccgtataaagtgaaccattgatatccagtggattatggtagaaatgacatgatctgcaagtaggagacgcagctaactgttctggcgagcatggaacacattctgtttcgaatcccccgtacaaaatagacaagatagatggcaaagataaaacaatggtagcgtacaataacatcgtagaggaaactccagcgctggtgggattatatcgttgagttttccttttcagtgcaccactgcacatagacagccctggaagaagcaaaacagctgccagaattgatccaactatggatccttcaaccaaacgactcttatcttggttcaaagcaacacaataaaggaagatttccacgattgtagagaaaaatgcattaataacagcacctactcccatagacgtttgcgcagaaatggaggccacagcttgaccaataaagtaagccagtgggatgattgatataaggcacataaggaatacagtcgatgagtctgtcaggattgagtggaatccaaatttctctttcaggagatagaaatcgaatatggtgaaagcaactaagaagagcaagttgatgaaataaatattggttccatccactgtgtacttgtaataatgccatccaacggctctatatgtacagattaaaatcgattcattggattgctcaactcctcgtctgtcatagtggtagtttttctctactctaaagaccaaaccaagaggatggcggcggacatgactatccaaaatcatagccgtctttgctaaaggaattgcaaatactgttagccaagcacaaatggaaataatgactaggaatggttggataataagatagaaaaggataaagaaaactacccttccgatgttccatttacctcttccaaatagtcttatcttgaatgcatcatcctcttcattagtcgtgtcaattgactcttcccctgcagcaccgtaagaatggtgaggaacagcaccttccctttcaactgtggaatgagccctatgcttcttttttggagcataaaagagcctttgttcttcatcagttctccatctcctgtattcatctaaagaggacccgacaccttcatcctcattataatacttcttctctttcctaagaagcacaattttcccaaagggatttaataaataaaaaccaatattatagagttgtttagcatatttgagagagtcatctttcttgggattagtaaaaaatgtgaagaaaaatgtcacagctgaacagatgagcaatactaagaacaagaacaaacccagtgttgcactgtagaggtgattagtcaaagagacatcccaagagatatgtctggccgccaacggggtctgatgaatatcatagtcagcttctttctgaacagaacgaattttcttgtataaagcaggtttccaaatccttactccgaaaggatgtgtgttgttaatggcatcctgcctctctctcaaagtaaagctttctagcgaagaaatcgacgcactgtcagagctagtgttctttgacccaaggccatcctgatcttcatccctttcatgatacccctgtatattactcgactcatcgatgaattcttcgttctcgtttgattcatctggaactggtgctggatggtgaatctgagaacttgtgttggaatcatcctcctcaatgggttcaggaacgctagactcttcattgaagagaattttgtgggaatgaggatcagactctagaacctccaaacggtccagatccttactcactttgctcaattctttggaaacctcagattccaattgttccacaagagactctcgttcactgccactggcggtggtcaatttcttctttggtcctggaatgggagagtaaagcttcgaacctttgctcttggtttttttcagacgctgtttcaatccatccctatacccttccatgtactccctattaatgtctgcttcgatctcatcctccccgtcgtccactgaaaaaacatacttgataggggggttctgcttggatttccgtcttgaatgaggagagtcaattcccgaagattttgtgacatagggactatcagctggtagggcttcaccggggttaactactgccatttgggactgctgcttacttggcaacatgatatattgtttgtgataactgggagtgttggcggaggaggagatagaacgagaaaactgaggtctcacagaagcctttctggttctggcagcctgctgactggtgacaggcttaatgggagaggcattctccaaaaaacctttggattgttcggcgctgtgagctgtggctcctgggggataatgggactttactaccggtgttgaggggacagcaggagacgggagtacggatgctttgggatccaatgaatcagccgggggttcttgagagggagtttcgccattggacttcttaccactcattaggtgaatagttttgggggtgtacaactgaaaacgaagttgagttaggaggagagataggaggatttttgattaggtaccacgtttggcagatgagtttagagtggcttctcgcgcttccaataccctattaaagttagggcacttctcaaatctttttatagaaaatggatcctaagggacattgaagattgttagatgtatatatacaattgagttgcactcgtctcagactatccgttaatcactttgtcggcccaagttggcagcacgaaactctgagtgtgtatttcagagttgtagtaacgaaatagtgccgattcctcttttcgtgaaactcgtctacttggagtgataagttcaatttctggagagtctgtgcataccatgagtcctaactggcctgatgtgtaggttggaattgtacaatatgagtacttgacttggctgaaaactttttcacaaatatttttcaactttttcaggttggcaatcttaagccaaatgttctctgaggcctgactgataactataccattgggagacagtgccgacttcagcaaatggaagtaattctcttggaagaaagcttcagctggaccttcagggtctgaggaatcggtaatgattacgtcaaacttttcactagcctcttctaagaatttgaaaccgtcctggatgcatatcttcaccttgggatgatctaaagcagacgacattccaggaaggtatttacgactcaagtctatgatggtagaatcaatctccaccagagtagccgactctacagagggatgcttaactacttctcgcaacactccaccatctcctccaccaatgactagaactctttttggattgggatgactaaacatgggcaaatgagtaatcatctcttggtaggcaaactcatctctttctgtcacctgaataattccgtctagcactagtacatttccgtaatcagtagatttgaagactaaaatgtcctggaactctgatttttctgctaacaagatctcctccactcgaagcatcattgcctggcctggaaagtattcatcagagatttcacgaaaccatccatctatgactcgggggtgcgttaatttagatatttcagacattttctctgaactttgataatggacgtaaatgacaaccgagaagttcttccttccccttgaggtttttctagtggggagatctaataattttgggaaggctcgtccgcccttgcaagggcgattcgtgggtataacatcttcactcaaaccttcatactttcctctgtagttcttatctatggacagtgatactctaaatcaattccagagtataaccaatcaagtcttcagtacggatcaagctcagcaaatactacaatcacacgactggaacttggaagcctctcttatcgcagcctttgatcaaaacccacagcttcctcgtgctttatcgacgcaaagccgaaacacagttttaaactcaaacaattcgaatatggaagattctatccgtaatgcgtacaaccaagcttttggaaacagcaaccaatcaactcctgtgaactctgaagtccctggagcgtttccttcaccctatgaacaaccatcgcccttctcagacagtttttcgaagttgcacaaagttgccaaaactttattgaaagggctcatcactatagtaataatacccttgtgggtgctttaccaactgttttgctacctgagcatctttgcagtcgaaaagatagcacctgcattgaacaagataacaggacttaacctgggaagtggcagatccatttactcaatccgtcgttctttagacccaagtgacaatgctcggagatttatagttgcctttgacgaagaaattggaaatacaccagcaaatgaagcttcgtgggcagtcgatagaccaccctttttggaatgctcctacacgcaggcgttgtatattgccaagcgagattgtaaatggttacttatctatctgcaaagtgatgagcatgaagacagagctcaatttacaaaagagttgcttctcagcaagcaactattaagattcatcaatcagtatgatatcatggtgtggggtgggaatgttaaggaaagtgagagttttcaagtcgccaacatgttcaaagtcatgaactttccttttctgggtttattatctctaactctcaacaacacaggaaataacaacactagtagttccactcttagcttggtagccaaagttgcgggaatttccaacaataagccacttcaagttaaaaagattataaaaaggttcacgaaagtctacgaacgttataacccgacagtggaggctatcagagcacaaagaaattctcgtaatgatgaacagttccttcgagctcagcaagaagaggcatatcaaagatctttggcacgagatagagcgagagatgaagaacgaaatgcagctaggatacgccaagaaaaggagcgtcagtggcttctgtggagaagagagactttgaggcctgaaccttctaccgaattgaagggacaatatgcccgcatagcaataagaaccccagatggcaccaagataactcgaaggttcgataaagactgctcgctggaagagatctacgcatttgcggagttttacttgaggccaatccctgacgaggatatcactgttccagtgagcaaacctgaaaattacaaccattcttattcctttagactgatacaaataatgcctagagagcaattgcctgttgatgagtcaactaggatacaagagtgcgaaatcgtttggcccactggtaacttaatattggagaacgaatagatatgtattttaagatcctattaccatgcaccctttcctctcttcttcttcgccttgctcttcttactactgactttcttggtttctgactgcagtttcaattgggagcttcccttcaatatgtccacataatctctccagaaggtgcttagctgctctgaatcaacggtggttgaaattcgcacctctggtattttctcctttgcgtgtctagctgtatatctgaataaaatggggtgtgactttgaatcattctctacgctgtttcctattatagagtttgtctctactccttgtgggatatctctgattccttcaggcgtcccttccacgggatctgcttctagagacagtcgtttgattgaaaatttcgagttccaaactgataaagtggctgttttggaaacttcttccaggaactagtatatgtcagtaaaagggtacttctttggttattcttggactcatacctgtttgtgattctctatcaagatcctgttcttgtttttcttagtagttgtggacatggttgaaggaagatgttgctgggtggaactttttcgctggatagtacaggttatcgcgggacgtcgagagggctcaggaggatccaggcggatcactagttgttttcaaaggcgtttgtccttcaacaggagatattcgttacagtgggttcaatacatttttaatgatgtcacttagctattaactcttacctttgaagcagcagacaaattatccacaagaatgatttaacctagcaaacactagcgcgttgtaaagtgtttcatcaaattagtaactgtttttacggttccacgattagttgattatgggttccaaaatacattggttaatattttaactgacctatcatgtcctacggtactttgattcagtaatagttatagaacaaccaccaacataatctccacaaatactttaaagcttgtacaaggcaacgtggccgagtggttaaggcgaaagattagaaatcttttgggctctgcccgcgcaggttcgagtcctgccgttgtcgtcattttttaactcattttgttaaccatagtcaacaccaagattatccaatcgtcttactatgttgagaattattaatctattgcctacctagtctgtttggaaaatatatcctctagctcttgtcctgtgaaataccgtctgttgctgataagatcattggaaactatcaatgtttgaggacctttgaactctaccatcaactcgtccgccttgttcgtgaggaatcttctgtaaaatgacgccaaatagccaagcagctgattagctctttctatgctctttgggctatccttgactaccagttcttgctcaacatcttcagtcttagaagttagctttgcattgatctttttccattgagtattgatcgatgctttgagttttgaaaaagcattaaactcagggatgctaatatccaagagcacctttctgttgttgatgaattgatatttgaaagggtttagattgtcgtaagcaactatagtagaaggtgcgaggtatatggactctccttctaataacttgatttcaaataagtttcctggatggctcaaagcgaagattccctttcctgagagctgcaagcccttctcactaggttctaccgtcaacccgttgccagaccaagcgacgagactcgatttgttaaccacagaccattgatctttctctgacgtcttcaaggacaaaaaatttgcattggtagaggcactggatagtagcagactgatcgggttgatgttgaaacacctttgatacagaaaggagttggtaagggtcccgagtttccccaattctgtgtgcaattgtgaaatgtctccattcacagctacaatgttgttctgctggttgttgaattgcaggtccaatacggtggaagacggtagtttcacgttcaaaagagcattcgggttccctattatgtcaaaagtggcaggctcagcaaatggacctgctccggagactgtgggcaattttttgatgggtttgagaacttcattagaactctttgaagacgagaatattgatttgattgcctgaaaggatatatgccgtctgtggggatgcattgtgtgtacgtgttaatgttatgaggggtggtttatgttgattcgatgaaaattgtgagagtatttttgatagctgtatgtagtgagaatacgcccttactcaaaagaaggggaaatttacatggaaggaactctacagagatcttactaatggttcaagacaaccaagtgatcttttttaaaaccatctatgaaacagattctaatgttaaagggtaattaggggagcaaatagttcatctattctagaagaacagaatggaaatacaacttatcagtcccccaacgaagttgcccaaaaatgcacctacgagtaacgtaattggccattcctgccatggtctatcccagtctagaggaatcggcgtgatacctaaccatgtaccaaatactgttcctagtaatgtcatgtagacaatatgcttggaaatgtctccatgaacttgaacagtcaccaatcggaagaaaagtgttgaaaacgtcattccaaagtctttctcggcatgggttgctctataggtggacagaatcgggaatactgtcaacagtgaaagatgagcagctaataggaaggtttctttattcaaactcaaaattggggctccaaaaagtaataagagcatatggacaggaacggacatgatcaagctaatgataatattcaaaatgataactgcaaaattgccaaagtagcttcttttccgactttgtgttgagtcttgtgaatagttgaataatatgaggacaccgtaagcaaactgtagacctatcaaacccttcaatgattgtaccaatgcctcatttttatttgtcagaacatcatactttgcaaacaaggcataggctgcgtatagagactgaaatggtaatactgttactggatgattcaaaggagggactcttagcggagtaacattcggatttttttcattctttgtatcgtctccgtctttcttagacggtgacaacttggaggaatcgctactcaacccttctgagaaggagacggcctttctcatggtgatatttttagtagctgggatgacacggttcaagaaggctgatgagtttgggtttgaaaatacgataacacatactagtcgcgcgaaagttatgaaaaaggtgaaatcttagtctctatgtacagttctaactaaacgcattaggcagatgtggcttcatctttgagcttcttgagagggattagacggcttgaaatacttttcataccatcccaattctttaggtttaacagtgtcaccggggttcttggcaataacgcaccacgtcgtaccaaagtggtgtctcttttcttctactatctccaaacctgattgatccaacaattctccaatatccaagttccacctacatccccaagttttactatgtctatcagcacgagagtctagttgattgttgatgaaatcataggatcccctgccatgttctaacagtataacacgtccgcctggttttaaaagtcgtgccatatttttcagcgctttaacgggatcgtaatgtgaacataaaccaaatgtttcaacaatgcaatcgtacttaactgcatcgtctttggatgttatatcaagcaagtcttctgcctttcccacaacaaatgctgctcttggaaattgagggaactgcctacgaaatttttctttcgcaatctccaacatcttggtggatgcatccaggaacgtaattgatgaaatttgagtaggatccagatatttgatatttcttccagtaccacaagcaacttccaacacatctccctcaatttctttcattagccattttcttttgcttcccatgaaagaaagagtctcttccaaattgatatcactatcgtaattggaagccagctcgttataaagctcagtcaaatccttaggtggtaagatcttggtctgatattctttgtattcactgatgtcttctggttttgggtcaaattcaccgatttgagctagctcctcctcagaagttgctttaaccagcttcatcttatattcgtcccatagtttgtgatactctgccagcttgatactgtcagtggttctcaacttgtcgtgattcaactctttcaatcggagatgttcccattcagaaagagttccttctttctgaaatttttcaaccaatgcttccttttctttttccttagcaaatgccttcttgaaataggtaataccatatagaatgaatgccccgtagcctagtatgtaccacttcaaagcttttcgatcgtactcgttcgttctggcatatgctgcccaaatacggaacctatccccactttccagtgcttcttggtaccgtttctgggcctcctcctcttttaaatcctctttggtctttttcttggttttaaactgaaaagttggcttattgttcaagcaccctaatgttgaggagaagcatcgctttaagcacacgtcaggggcagtaatgaaccttgcagccgacttgtccacagttcttgcaagaaacatcagttatggaaccagcctgatggagatttttttttcgtacaatcgatttgatcacgatcctacacggtctacacgcgctcactcgggctatcttggaaagattcttcgaattgcaggaagatttctcccccgagcaaaagcctgtgagcgaaattcctcaacgaaaagactgataaatataccgttccaccatcacttcctttggactacccatacacacataagttcttgaattaaacttcagtcaaatttcctgtctcataattctaccaatattattgtgcaaagagacgaaatggactccgttggtgctagtcagatagtggcggctctggaggtcatatactccatgacatctagcaatgatcaaagacgccaggcgcaagagttcttggagaagatcaagctggaggagcagtcaccttactggggatatcaactggctttaccggacaacaataatgaatttgttgtaagacattttggcttaaacttattgcagtccgctatacataatgacttagaatcttatgatagtacgaaaagattggcgataaggcattggatcgtggaatgtgctaataaggtaactcctcaggatccccattatataaaagaaaagatagctcatttgtgggtttctgtggcgaagagatgttggggaacgcatttattgagaacatccccaacccccaattcaatcaacacgaaggataaactcaccgaagcggccctagataatattcaattaacagaggatgaaaaattagatagctggatatccatggacaaagatcttctcaatttatggaccttaaatgaagtcactcgggaactggcacttgtgatattcaggactttatttgaggacatttatttattggatgatccaattgcagcttccagacagatgatccttaccagcctgggcgcagaaatagtcacttctgaagcaatattaaacctgaagtttgtccccacggaatcagttcggcaattccgagcggaaaaccaagggtggttacttagatgggctgagttctttgaagaatgcttgggaattctttacaataatcaatcatcgcctgaaactattgcaaaatcggagaacttctgccttaagattttacaaactttaaagacttcgctgcattggactttccctattgctttaagagatgcaaagatactggaactactttgcaaggcgtttatgcttcccaggacccaaatcaggatccttgcaacagactgtttgcatgttttatttacaagaagtttttccaatgaggaagattttgctgatattgttggctccgtgtttaaaactgaaggaatcgaaatgctttctcaagtctatcagtcaaccatactggacccggacgatattgatgaacagaagtacacactgcttaaaaaactagtcgaaatgattgtgggccttggagaatatctgggatccacttcctcgtcgtcagcagcctcacctcaccaacttcctgatgactctaatatagaagcctacttgaaattggtgttatccaccctaaatcatgattcattaataatttcaggcttatctcttcagttctggtgttcgctgctccgatctgacaagttgtttcaagctactcatgttgaattgttgttgccagatctaatcgaagcttgctccaatagactgctggattatacagatctgtcagaagaacacacatcaaaaaaattccttgaagttgactttgatacgactagtgaatctaaagtgtttgtcagcaactataaaaaattcctggaagatataattaggataagcatttgttgtaatcctgaatttgggctgaattggctgaacaacagattaaatcaatttttcagttccgaacttggagtgaaagcactatctgagaagaagctgaagtacaaaaacgaagatgctgagtcgtatatttatggtgtctcacaatttcatattattgaatgtgcagtgcgtggggtatcaagatgggagatttggtacgatggtagtgatttagaaacgaaaaaacaatactatgttcggttggttagtgatctttgtgagaagctactgaatttacatattaacgacccaaaactactaagaaaacaaattcaaaccctggtccaatttaccccgctcttgaagacaatttctcaattgatgtttaaggtactggagagtgttatcaattctactacttatgaatatccggaaaacgctactgataaagaacgtgaggacattagggatttacgtaccagtagtgggacagagctaaacaggctagcatacttgataccacaagaattgaaaaacattctcgatcagttggaagaagtgattgcaaacattttatcttccgataaagttagtgatcacgaggctgttgctttcaaatcctttttattggttgtgtcccaaagatctatgattgaagacagcgaacaaagatttgcaaagattgttgatccggagttagctgcttggtctgatccagcaactgaaaagggacttttggaactcccttggttcatggaaaggttaggaattgtgaaaatcgctgaatatttccagagcagaaggatgacagtcgacacaaacctattggaggcggatatggatgctgccggaagagccttgcgaactgaccttaagaaacattgggagtcagtatttccaatcagagccactcgaatcttgattcagtacagtatagaaaagttggatcatcagtcggagcaatttcaaaagcttcttgcattatggaagcctagagtccaaccaattattccacacgtattgcaacttctatcacaaattcaagcataccataacccagccaattggactgacattccaactgaagttcaagtgtttgtcaagtttacaactttggaacggttttggcaacagggggtttcaatgcagactaaggatgcctttatggaagaaaatgtgaaagccattcacactttgagagatttcgcagataatgtcggccacattgttagatacactcgggagtacgcatatttaacaataagttccatttctgaactagaagagacgttgtacgaaatccctaacattgctacattgctctggaaagcattagccggtgatagcgtgggtattacattatattcttggagacatatgtttactattgtgatgagggctgtgtttaaaaattgccccctgaggtacgtagaaccgtttttaagtgagctgctaccccagatgttaccggaagtggataaacttttgagcactcgctgggaaaaagtttatttgcgaggaatgcagaccgatggttctggaaacgacgaagctctaactgaagagatgatggaggagcatatgttgcgacaacttacaggctcagtggatcgaatgctaattgatctagtaggacagtggacaaataacaagctaagtgacagacaaatggagtgcagatcagtcatctttaacaacaaaaatattctagctccttttttgcagctaatttgcaatattatcatgtacaaagatacaagatgttcgttcaatgctattctaattgttaggaatattctacctgacattttactgaaagatgatgaggtagacaaataccttgctgataacttaatgaaagcactgctacaggttctgatggatgaattctttgctgatgctcagcttgaagcaggactagcgctggcttatttatacgtgactttgagatccaaggcttcttatccagtggatgttctccagagattgcttccaacactgacttcgaaggctatagttggatttgaaacaattttaacctcgtcgactagtctaaggcagcaaagaaacacattccaacaactgatagccacagtaagaaacttagacgagagtgcattaaaaaccgcaagagataagcagctggagaatgcagttcacaggaagaaacacgaatctggtatcaacaaagatgttatggacgatccctacctggaaaatggagcattaaatggtttattcaatgaaaatgatacctaagcagataacggatggaatataatatatgaacatagttctaatcgccttctgagtatgcagtgttaattgaatgaatagcttgctttttaatttcctctgtgaacatttctccaaaaatttcttggatcatgaaataaaacgcgtctttggatatctctgctcttgctcgtcgtcccaagaaatattcgaaaaggtccgactccttcctagattctttgtcatcgcctaagacccgtcttgagatgtattcctgtttctctagatagccacaaaactctgggattgacctgtttccaagaaattcatatcttatattttctttacagcttattttgaatgtttttgaaaggaattggtggagctcatcagatgtaacacgattagagttgatcactattacagacagaatcactacattgaatccctgatgtatcaagtctgagcctgtagttggtagtaaggagcttgaatcagcgacttcctccaagctattaatctttgcgactttttgctggtaaaatctgaccagcttttgtctaatatcaaccggtaaactattcaccaaaatataagacgaattgagtgtttttttcctttctctgtcttcggatgtgttgtctactttttgtttcttgtgcttgttagtcttttctggtagctgggccagctctaatccgaatacatctgttagaatgctatttgccctgtggaatacacgatcaaaagaaactttggccgcattagtttccatcattgtgtacagtttctttagtatagtgttgttcaatacctgatattgcttttcatagcttatcgaagctcttactaaagaaatggccatcttttccacctcatctgaggtaacactagagaatacaggggatgtgacacgctcagtgggttcggaaggttcagaagtttccgtgccatgtttccgcttcttggacttcttatctgctcttctatgatttacagaactgttagaaggttcctcttcattctgagaagctgaagcagaaggaggggaaagggagatattgtaccttctagccatccctcttcagtgccagaagaagagaggatttattgatgctggatgtctaatacagtttcaacatccttgcacccaaaacaagcatatagaacaaatcacttttttctattttgggtgggcgagcgaaaggttcgacacgataagaaaaaccctagacacgtcatcatccaatcagctccaggtgactgaaagactgtgcactattcagatactcgtaaaccgatcagtgcaggcatcacctctagaatgagagctgatccgtgctagcctgacacagcaccttcttttccttccttgcaggtgtggtgcgacccccaccaaagcttaactacacgtgactgcaattctgcgaccctcttatctttgagcgaatcgctgttctttcttaccgttttcctctggtgagcataccttgatccgttcctctcaagtgatggctgaaaagaaggttgtctcgttgatattttcagctctagtatcacttgctgccggaactccttacctgtttggtacttatgccccacagttggcagtgcagtgccatttgacagcgtctggtgcagctaccttatcactggcctccaatgttggcacttccattgggggtttgcccattggcctgttcatagaccataacgggccctccatgtcgattttcatcggcgcgtttcttgagttcattggctttggctgtctctactatgcatacatttacaggattgacagtctcctggccctgtccatggccatggtttgcactggtatgggatccgtgttaagtttttattcttgcctcaaatcagctactgcaaattttcctaatcacaggggatctgctggctccgttcctgtgtccagttatggattatctgctttgatgtatagtactgttgctgctacatttttcgctgacaatacctcaggtctattgaaatttgtttccctgttttgcggaatagtgattggaattagtagtttctttgtcattctggtggattcaggacaccctatcacagctaagacacccagaaggcccaataacgaaaatttgcttcaagaaagggctagggcaaagcctatcacgaaagctgacggatatggatctatattgatggccgcacacaggggttcatttgcacaggcgacattaatgtcgcagtctgtatcttctttgttttccacagccgggccgcaatcagatagctccccggaaagttctcttagatcttcaaattcctcagttctttcgttccatgaaataccaacgagcaacagcgctgctgtctctcgttcaaattcattcttggttggatccgctggaaaatatagttccccgctttcaagtttatcaagctctccagttaataccaaggcctctaatataaagatctccatgaacaatcgtccaggtgtatcacgttcggtttccaataatcagtcatttagaagcagctctaacctttctaagcaatttgcgcagcatgccgaaatgcaacaatcccagaatccatcaaatgcggtgaaaaacggtggacatgtgggctcccctttgcgtggcgggtttatgttgtatgactcaggcacaaacgaagaatctgcccatactttggttaaaaaggatgaaccctcttcgtcagaagatattccacagaaatatcccagggatgactcgaaaagtactccgaggaacaagcagaaacctaaacctaagaagaccaatgccaggaagcacattaagagccttgtgacaaattacaagtttgttattctgtacgtggtgatggctacattgtctggtgttggacaactgtatatttattcagtaggctacattgtcagtgcacagatcaataagggctccaaccctgagcatttgaatggtgctggttatcaggcccttcaagtgtcgttgttatcactaacttcctttttaggcagattgatctcgggtccgttatctgatcttatacacaaagtcctgaagtatcaaagaatttgggtattggtgattgcaagttgtgtgagcgccatggcacaatacttaatgatctacttagatgatgtgcacatgctgtccgttgccagtttgattgtgggaacgtgttacgggacagtgtttggtgtctatccagctgtgattgtagactattttggttccaacagttttactacaacgtggggacttgttactaccagtaatattgtcagtcttacagctttaaacaccatgtttggttacgtatatgaccacaacagtgtttgggatgacaagaaggagcaattggtgtgccatcttggaaaaaattgttacaatgacgtcttccgagtcaacctatcactgtgtttcctggcactattgctgtgtcttttcctgataatacagaaacgcaagcaagatcaaaaaatcgtaccgattggccttcaagtttgatatatatacagatctcatagattgcattaattaatcgatacaaccaaatcgggaaataaacttacaacaataatattcaacctttttcgtactctctctcacataatcatatttactcttcctccaactcgccgccaacaagtctgctattcagatgaccagtgaagacaaacgcttgagtagattttctcttccagaatcggaagataaaacgttgtggctaaacaatgttcctaaaagggtaatcccgtcccacttggtgaaaaggtcaaacagaggtttcaacatagattctgtaaaaaggaacgacaactccaattctagctcgtcgtccaataacaagagtgctgttaacgggtataactacactagttttggtgaacagaaatccaaccaaaagtcgatccctggttcaaacaaggaactaggtgcgtcgggattcttagatgaagggttgagtgatcttcctccgagaaaatcaatctacgatttcggaagtgatgacgacgataatgttgatcatttggagcctgagaagcatctgtttaaaacaaatgatgagatcatcaacgaccccagggcattcagtaatattttcaacccaaagccaagatttgggtcttccacaactgcacacagtaataataaagctcctttcaaggaaacattttctagagatataccttcaaattttaaaagggaaaatttggaacctataacgaatggagagtcggcagtgttgttgtttgggtacaacgattctagctttgagagcctgatacaaagattttccaagtttggtgagattctagaagatttccatatcggcacaggaattagtgggttttcaactataggaagctctacgccgttgaaaaggaagagcaagagttcctcaacctcaagatcagtgtatcctatttttgttggtaaacagtgggtcaagattacttacgacaacccatcatcagcaattcgtgcattgaaggaaaatggtgttattgtagacgatcatatggtaggcgtaatcccttatacaaaatctgcattggagactctactcaatgctaaaattagtgatagtgatgatattggagacactttgggaaacatttctttcggatctcccagtaaacccttagccagcgagggaagtgacggtttggagaacaacggattcaagcctctaagtcatgcatctcaatcgtttaagatcaaagatggaacccaactattcaaaagcacggccaaagaggaagagctgaaaaaacagaaagaagcacagcaaagtgttggtttattgggtaaagtatcacaatctttattcggatttagcgtggtttaaatgctgacttcaaccacgaggaaggtaacttactaggagaatctatatcggtgaggttcccccttgagtcatgaattaggaatacttttgttttttgggcttttgggaaaacttcaactgaatttgagttgaatttgtctgtagaatcgatggctacctctttataatctctggtggtattgggaatgacaaattttgcatcgtactcataggctacctctttcaggattagttccttttgatctactctatcttcaaactttgtagttaatgtgtacaggaaaaacgtcattatggcaaccgtaagcattacgttcaacgtaactccgtttaatattataattgaggtgtgaacaggggaaaataataccatcaaacgtagaaaaaacctatttggattccaatagtgtagaacccagggatcgtttagcttgattctgaataaacgttgaatcaaaggaggtagcttcttggctacttgattctgcttttgaaacaatttttcgtacttcaatttctcatgatagatgaacttataagtctttgtggttgtcagcactcgtatagcattgacgattgaaaaaataaataatgataagaacaggaaagtagctacactttcgcaggtgtactttgcccatgaccactctgaacttgaggaaggtgccagcttgccatactctttcaacttctttctctccaactctctgaaattgcttttgaagaaatggtcttcattataaatggaagaacttcgtagactgtttcttaccaaactcagcaaccaaaagagtacgttgagggcaactcccagccgcaaagctgttgtttcagacagttgatcccaatcaactatattgatattctcgttcaaattgatccattggtctataggataattcttaatcttcgaccaaagagacacctttctgatatatctatttcccttcctaatgagaccatgctgggattgaagtgccataccggtgagtggatggagggaaatattggataggaaagtgataaacttgttttcattacataatcaagacttggaccaggatgtcaaggaaacgcgcaggcaaagtagggtacgaacgtactacttacagctagcactcaaagttagaggcgtaatggtcactgcgtacgtatagccttgcgaaaaaggtagatgtttttggagaagtgtttctactaaccttttagagtgctctttgtcaacaatgccaccccttctactatcacggcgtttcatgatctcatctccaatgagttaccaacgatagaaggaaagtggtcctttcaactcaaaatattcttgaacaacaaatactccaaaccaacctccgtggcttcctctcaagttccaagcagatatctttatactttgcaattgtcctatctgccaggaaaagccatttcaatcatcaataataccaaagcgctagtgacaactactcagctgaaaaatgaggaaaaagcaactaattatgaccttgaagacactacagaagtggactccgtagaaaacgataggctaagaaatcaattcgaatgtggagcagctaccgatgctacaagtgatccttggaacgtcttcatttcgacaaagttacaaagtttatggaatctcaagcagacaatcaagggagagggaggaaattcatatgtcgtgtcattgggtaatattacagagtcgaaacatgaagtgttccgtgtgaggactacaaactgctttttgcatggggtttttaagggatttcttatcgagatagaatctttggatagtctagaaggcgatcaggacaatgaggaaaaggaaaaaattgccaaaatggatgacaaacaaaggctgatttatgaattcagtgtgaaaatcaataagatcaaaagactcattgaggtgtgtgattttccccaggggaaattgtgctttaatgtattgagtgatagtaagttggatcattatagtgacctatgccaacagtattcagatgctcttcagttttgattggcaaacttaaaggatttgatgaattttctttccttgtccaatcgaattctgacagctagtgcactctgttcataaatatcgtcttcttgagaggagttggagatatcagagtttgcagtagattgtcgaacacttgatgttttcgacaagggagaagggataaccagctgcgcattttcttttgctggagattttggtatgtccttgaaggttgagaaaggtcgatccttcttaggtgatagtggtctttgcttctggggggatagcggtctctccttttggggtgatagtggtctttcttggggtgactgagtttgatccctgagtagtgacttagggtcaggaacgcgagattgggtgatgggaattggtagaactctgtctttagttggggatgtaggcctggaaacaggcctggattttgaaggactggcctgtcgtttagattcacggtagattctttgagtctgcacatgaatggctaatttgttcacatattgccttattatccaagcacgatcatccttggtaaactcatcccgaggtttcatcccatccaagtacctaattgctgatcctagaatagaacttttggttctatatgagacctggtgttcctcataaatgttggatttttcaatgagaacactatagtattcttcatccgaaccattaggcttcaacacatggaattgaaagttctcttttcccaatgagggaataatagacgaatctgtattgtcagaaagaatcaataagcttcgcatcttattctttggaaagtctatcagtatccgatgctcgtctgtgaatagcttttcttcgaacctcttgatattatagatgacatccagtttatcattaccgtaattcccagagctcaaggtattgtctactttcattgaatatccgtaaccgtttgactcgtcggcctgcagaaaaggaccccatcgatctgccttgagcctcttgaatacataagtaagcgattttacctggaggtcaattggatcttcgttttctccctccaagtagttgggtatattatgaatagcattcctgatgtgtttctgttcttgtgagctctctgttccgccccaactgaaaatacccagcatttgggcacggtttcagaggagatagatctaattgaaatgaaaacaagcagattgggtaatcgcgatggggctccagagacgatctgacgtgagccatgcatgaattccttccaaaagaggataccagacagaagtcgttaaacagtatgtttctatgaaataaataactatgaaccgaaagaattgcacgctaaatggcaatatttgtttgtaagggctcctcttcaatttcaacctcgacatgagttcttcttcttttattatttgcggttttacctttggctctcttcccggaatgcttatcatcagaatcttcaccagagagctcctcatcgtcagactcatcagaaacattgtcggactccctgtctgaagcatctcccaaccatttttctaagtcttccaagtcaaccatttcgtcttcatcctcgtcttcaacgtattcaacttgaccgacatcagagtcttcatcttcatcctcttgcaattgatcgccgttggcatcaccaacaattccaagaaccttacgccaaacgtcttcatcaacgttgaggggtctatcaccatatgctccggacttcagtctatccaataattcagactcgatagccctctccaatttggcagcaatcagagcttttctctctctgaccagttctcttctcttcaccttcttcttcacactgacatactgtctctcatcatcctccatggctattcttctttgggtaatgacaacctgtgtcaaacgtgtcagtctttgcttgcacttgtcaattatgtatttgtcccagtaaatcaaatgttcaccaatttgctttagtgctttcttgtaattcttgctcaacttgactcgttcccaggttttagaaggcaaatgtgctctttcgactgtcttcatgtacagatacatcttcccatctatattcttgacggtggcatattgagcattagccaaaggacatgcttttctggaacagagaccttccacattgtattcgtttcgacaaaagttttggtcctgtttcgtcttgactttgaacgaacaaaactggttgtttatgacatcccaaataacctcatcagacatttctacgtagtcaatttatgggttctgtgtaagcttaatggtaggtaaagaaattcaaacagctttattttagttttttttttctcactaaaattttttatcttggaaagtctccgaacctacatacttttgatgagctcccatgtagtgaagaaacgataaatactccgcgagtaaactagcaaatatacctgagatattccacaccagcctgctccagtcaattgaacagagtcctacaattgtcgtttgaccaagttcgtttgacgatatgccttcgtaccatgttctctcggaatgctggcacatttagggtacacccgaacaccggataatttttggtttccgtcgcgcgcctcgttctaaggataccgtagagtaacctattgtgagaaagtgccaagtgcctgttatagtcgtgtaaactctctcaactgtgccattgaatccgcacaattaaggtacaacgactcatcaccgcttcaatgagtcgaaagaataacaatttctcttttgagcaggaaagtgacatcgatgacattgaccttctagctgacgatatacctgcttctagtaatcaacatcaagcgagttcaaacggagctacagccggacagaactctaatcctttcaaggacccatccatagaggaccagtacatctatccggacgtagagttggtggatctgcaaagtcggatagacacatcctcagctccgttgaatagtaatgggaacccatttgcagactctaaccaggtgttcgatgatgacaatgacattttgaacgaaagagtggcagataacagaagagatcttcctgatttcaactctccaaatgagtccaagtttgatatcaagatgtactggagtaaacttttagggaaaccttatagtaaggtacgagataattccagcccaaggatcatccatctaaatgaccccgttacaaacagtcattttagatacatggacaaccacatttccacaacaaaatataatctagcgacctttgttccaaagttcctatttgaacagttttccaagtatgcaaacttgttctttttatttacttccatcatccaacaaattccaggagttactccaacgaatcgttatacaacaatcggtactcttctagtcgttcttactgtgtcagcaatcaaagagattatggaagatctgaaaagaaatagcgccgataaggagctcaattcctcaaaaacaatggtacttgactctaaagctcaaaattttgtccccaagagttggctcaatttgaaggtgggagaaattgtcaaagtatcaaacggcgagccttttccagccgatttacttttattgagttcttcagagcctgaggctctgtgctacattgaaactgccaatctggacggagaaaccaatttaaagatcaagcaaggtaaatctcaaacttctcatttaacaagtcctcggcagctttgcaatttacaggggaaagtactttcagagaatcctaattcaagtctgtatacatatgaaggaactattacctttgataatcaagaagttgccctttctcccgaccaaatgcttttgagaggtgctaatttgaaaaacactaactgggttgttggattggtggtttttactggccatgaaacaaaactgatgagaaatgccacagctgcgccgatcaagaggacaaatgttgaacgaattattaatcttcaaattttggccctatttggaattctaatcactttatctctaatttcttcacttggaaacatcatcaagttgcaactggacgggaatgaactaggctatttggatcttgagaatacaaacaaagtgggcttatttttcaaaaacattctaaccttttggattctcttctctaatctggtgcccatttcgttgttcgtcagtgttgaattaataaaatattatcaagcttttatgattgcttcagacttagatatttatgatgaagaaaaggacacccctactgtgtgccgaacatcttctttagttgaggaacttggccagattgagtacatattctctgataaaacaggtactctcacaagaaacattatggagtataaagcaagttcaattgcaggtcgttgttatatcaaagatatcccagaagataggagggctattgttggtgatgatggtattgaaattggttttcacaactttgaggaaatgtatcaggatttaaattcagacgaactgggaaacattattaatgagttctttactttgttagctacatgtcacacagtaatcccagaggttcaagatgatggtactatcaaataccaggccgcatcgccagacgaaggagccttggttcaaggtgcggcagatgttggatataggttcacagtgagaaaaccgaactcagtcgtcttcgagaatacccatcttggaaggaaatatacctacgaactactggatgttttagaattcaactccaccagaaagagaatgtctggtattttcaagtgtcccgatggccgcatcagattgtattcgaaaggggcagataccgttattttcgaaaggttatcacctagtggaaatcactttgtggaggctactaccaggcatttggaagactttgctgcagaggggttgcggacattgtgcatagcgacaagagtgatttctgaagaagaatatttggagtggaaaccaatccatgataaggcctccacaacgttggtagatcgtcaacaaaaaatggatgatgcagcggagttaattgaaaaagatttattcctgttgggagctacagcaattgaagacaaactgcaagatggcgttccagatacaatttcctctttgcaggaggcaggtatcaagatttggatattaactggtgatcgacaggaaactgctattaatattggtatgagttgtcgtttactttctgaagatatgaatctcttggtgataaatgaggattcgaaggaagagacgagggataatatgctgagcaagttgacagcgttgcatgaaaatcaagtttctgctgaagacatgagatccctggcattggttatcgatggtaaatcattaggttacgccctggatccagatcttgaggactatttccttgaaatcggagtaatgtgtagggctgttatttgttgccgtgtttctccacttcaaaaggccctggtggtaaagatggttaaacgaagaaagaaggctcttctattagcaattggtgatggtgcaaatgatgtcagcatgattcaagctgcccatgttggtattggtatcagtggtatggagggtatgcaagctgcgagaagtgctgatttctctatcagtcagtttaagtttttgaaaaaattgctcatcgtacatggggcttggtcttatcaaaggatcagtgaggcaattctttactcgttctacaaaaatattgcattgtacatgatccagttttggtacgctttctcaaatgcctacagtggccaaactgttgtggagtcttggacattaactttgtacaatgttttttacactgtggctccgccaattgttataggaatatttgatcaatttgtgagtgctcgttacttggatagatatccacggttataccgtgtttgccaaaagggcactttcttcaacgtgactattttttgggggtgggttataaatgggttttaccattcagctgtcatatacctatgctccattttcatatacagatatggaaatgtactgagtggtggtcaggttgctgatcattggaccttcggtacagctgttttcacatcttgtacactgacagcactcggaaaggctgcattagtgactaatctctggactaagtttactttgttggctattccgggttcatttggtttttggttgctattcttccccttccatgctactgttggtcctctcatcaacgtttcccaagaatacagaggaataattccttcggtttatggttctttaacattctgggctatgactttggtggttccaatcatgtgtcttttaagggatattttatggaagtactacagacgaatgtaccatccggaaacatatcatttcgttcaggagattcaaaagtacaacatacaggaccacaaacctagagttacacacttccaaaaagcgatccgaaaagtccgtcaagttcaccgtatgagaaaacaaaggggatttgccttttcccaggccgatgagggccaagataaactggttcgcctctacgacactacaaaaaagagagatataaatggagtgttgtggtgattcttttggaaccagtcattcattattcgttatttaaatacctttcttctgtatatttgtatagttcagacagtcttctagtgttatccagcaatttaaagttgagatcttgcagctcgttttgaagctggtgggatttttctatcgacgaagagaactttggaactcttaccaggtaatcatcttgtagcttccagccctccaggagatctctttggattgctgaatcaataaactcagcaaaaggtgcaatctcaagatttgtgccatctatatcaaaggaaattaggtcatcgaaggtagccttcaaagtgtctatttgaattcttacaagaagtttcaagctggtcaacaatttgactaaccttagcttctcaataagaagaaaatatatctcaaatttcaattgtgggttgagtctcagtattaaattttttttgctcaatgtcaggatcaatctttgcacatccagatttcgatacgctgtcatgatagaactcaaagtattgagctgcttaaagtgaactttgaattttttgaaaaatgagtactttaaaggtttgttggggcttaatatcaatgagttgacaataacgagagttctgattctgtttttcaataaattagactcaatcggaatggctaaggataccaatgtcctaagataagaattggcaagttgaaacttgtgtaagttcatatgagcaacacaaattttatagtaccagtttgtaataagttcctgcttcaaataattggaggagatttctgtaaaatctgtgagcttgtacttttcacaaaggtgaaccacttgatcgtactgtttcacgtagcatagggaatccatagttttgatagttagataatctaacttggaattccaggataacttcctcagcaataaatccagtaaagagcttgctgcagactcatattgcctttgtttgatcagtttggtgactattctgatgatgtagttgaaattagtttgtagttcgtctcccaagtcaggaattggctgcaagaccaactctaggtttaaacttttcgtgtacggctttaagttctgcattaattgtagtatatggtattctgcttcattgttgagattcttatcctgagattgctgttcctgtatgaactctatcgtggagcacagcttcgtcagtgttaaggtccacagtacactatgtttctcgatattgggataacccgccaattcgatgtcggagtttgtgagatggttcgaaatggtgtcataaagatgtactatatctaccgaagaagactcttcggtatttattgacgtcattcaatgctctgtgctaagtatgaccagggtcaggttcaaggataaggttcggttgatctccgcgcgacggaggagggaatgggatgatacgtcttaattaagtaagcatgcgatgtcttatcaaagctcttctttctccccacatttatgacaccaattacaaagatggacagctggctcaaacaaaaacggtgcagagtcctagacggagctttaggaacagagttggaaaagctgggtattgatatcaagagtcgattgtggtcaggaaaagctcttttctattctccagagactattactcaaatccatagcagctatattcaagcaggagctgagttgatattaacatgtacttatcaattgagcgaccagggactgaaagatttagggattgacgatcctgatgtgtacgacagggctgtgaagctggctaaagatgctgttgaccagaatgagggagaaaataaagccaaaatcgttggttcaataggttcctatggtgcctatttatcgggaggagaggagtacactggagagtatggagctattagcaagtcagagttggaagaatttcatagagttcgattacaaagtctgctcacaaatccagatgtggatttgataggatttgaaactatccctaatattttggaagcagagactttggttgtcctcttcaatgcgttagcgaccagtttgaatgttgataaaggatattacatgtcgtttaattgcagggaggagagcaatcaatctgtaatcgcagatggcacctccataccggaagtatccgacagattgtccaaacttgatgtatccagaatgtatgccataggtacaaactgctgcagcatcagcactgctaacggggcagtggagctattctctaaacatacaaaccttccattgatcgtttaccccaattctggggagagatatgacaaaactgaaaaaaaatggctccctggtgaatgcgaccaaaaaataactgacatcgtagtcaattggctgcaactgaatgtaaagatcattggaggatgttgtcggaccaatccccactttattcgtcaacttagagatatagtcgacaacagtagcagaagtggatgaagatatgacatccgacatttaacatctcagtaatttttttttctcgacctgacatctcatgaatagcatgaatagggtatgacgaaatgacgcactcgaattattttcatctacctctttctaccctatttatataaaatggctgacgttattgctaagaatgcccatttggcatccacagtgttgaaaactttgactgacaatgagaggtctgatgccttggtaaaggttgagcgtgccttgaaactgaacaaggatcgaatcttggaggccaacttggtggacatggagacagcaaagaagaataatctaagtgactcgttgattaaaagattggatttatccaagaacgacaagtttgattccatgtgccagggtgtgttggatgttgcccaactggaagaccctttaaacaagatcactttagccacaaagattgatgacggactgaatttgtatcgattaacttgccctgttggagtgttgttgatcatattcgaaagtcgtccagaagttattgccaatatcactgctttggcaatcaaatctggtaatgctgccattctgaaaggtggtaaggagagtttcaacactttcaaggcattgtctgacgtaatcaatgagactctgactaaagagacgaaagtaccagagaactccattcaacttatttccaccagaagcgatgtcagtgacttgttgagtcaggacaagtacatcgatctggtgattcccagaggctccaacgcattagttcgtaacatcaaggacaataccaagattcctgtcttgggacatgctgatggaatttgctctatctacgtggatgagtttgcccaacttgataaagctaccaagattcttatcgactctaagaccaactatccagctggttgtaatgctgtggagaaatgcctcatcgacgagactttagtaaagtcgaacttagacgataaggttgttcctctattgaaaagtttgatagaagctggtatcactctccacatcgatcctgaactgcttaaattgttacctcaagagatttctgctaacgaaaagactgttgcagcaacggaagacgacttttccagagagttcctgtcctttgaccttgccgtcaaggccgttaagaatgttcaagaggctattctccacataaatgagcattcttcaaaacatacggactgtatcataaccgagaacaaagaaaatgccgatagattcctacaaggtatcgactcctcaggagtttactggaattgttctaccagatttgctgatggtttccgttatggatttggtgctgaagttggtatctccaccaacaaaattcattctcgtggacctgtgggactagagggattagtttgctactactaccaaatgcgtggagatggccacattgctggcgattacgctggtgccggaggggttcgggttttcaagcatgagaaaatcgaccccaattcagtagtgttgaactaaagtaatgccatgtttagatcgtatatagcggcaactatgacatgtttactctcattcctcgaccgaatgtgtctgccaagataagactaataagtttgctgcatgtttatgcatattttactttatcaccatggaaacatacatattcttgtagctttggcgttctctgcccgtcatcgaaacagtcgtttatgcaaacagacttaacctgttctcgaagcggtctccagctatcatcatgccaatacttgctgtacctgtaggagcttgtcgtgggttatctcttccatcatgaaatgactaacagaacccccatctaccatagaactaataggaatgcacctgaaacgaaagtggttatcagtcattacttatcagtaaaaggactacctgtaattaatgcttcaaatgactagttgagtgcatcatcatgtacagtaaaaaaaagaaaagttgcgctagtaaattaaaaagaagcgtggccctgcttgccatgtggcccccacttgactttctcctttattggcaccagtaaaaccggtacacaaattccactccagcaactgtcagacagtgacatattttttattgcaccacttactgaatgtttgatggtctgaaaatcagttccactagtaggcctcgtcagggcaaagcgaagagtgataccaacctatgcattgatacccatgataccatctctaaatcgtttgacgatgatgcctcctccgacaatgagatattatttgactcacaacaatcaccagatatgaccaccatcagtggtagtttccaatcgccacttaccccattcatcgtagactctgctacctttactcataaaccaatattattagaattagagaacgaaatctcctccatatgtgcaagagttcaaggctcagtgccaaagtcctcactttgcatagatgaaaggctctattctgtcaaaataggaagacttgttggaaccggtggcgactcaagaatattcgattgcactcttaccggtaacgttcccaatataccacttccacgtgaaccactcgtgattaagatacctttgaataaatacggatgccgatacattgaacgggaagcacaggtgctttcaaagctcaatggagatacccgatttttgcattcgtatgggctgtacaacctatcctccaaagaatatcctagatgtccaaaagatacccagtttccctccctagtattacccaagatggataccgatttagaaaattttataaactccttagacgctgatgagcatgtggagggagtctttattggaaaagatagatggtggagtttagcaacctgtcttttccaaggcctactctcaatggaactttctggaattgtccattgcgatttaaaaacatcaaacattttgatgaagggagagtccttctcaattgcagacttttcttctgcaagattttattatagttctcctgttgacaaggagcaaagaggtaccctgacattcactgctccagagctgttgaagttggacgctgaacctccaagtttccatacagatctgttttccgcaggtttgattcttctccatgccgccacaggcaaggagccttacagtggaattcataacaatacacaactgatgctgctagccaaaacaggtgctatttggaagttactagatcccgaatccctttcaaggctgaatgaagacagcaacatttataagatgctgcatatgatcctcgtggagagatgccagctacaccaattacagagctacttctgatttcttcccgttataccattttattcgtttcatcttacacgtcttccagacccagttttattataccttttgcttatgtaatattatttagcggaataaaatttacgaaaaaaaaaaattatagttctgttacttagtgaagtcccctacgcaatggccaagagatcaaacaagcaaagtagatccaagaccaatagaaggattcaggatgccttgcagatagctgagaaatcagaaaggtatcagaagagttcaaggaaccagggttctgacgactctgataccgatggtgccatcatgaacgcgaagaggtatgttcaaggagactatggagacgataacgaagagttcgtcgacgaggagattgactctgatgaggcatttggtccagatgatgattttgaaacttttaaatccaagggcacagacaaaacaacagcaaaaggcaaaggaagagggaagccctcccatttggaagacgaagatgaggtcgacgaagaagaagacagcgaagatgaggagggacttgttactctttctcaagcttgggatatggatgattccgaaaagaggaaggcaaattttgccaaaagcactcaacagttgatattgaacgacaacattgattctgctgaatctagctcagaagctgattcctcgtccgaagaagaggaagaagaggacccgtttgcagaaatggaatcatatgatgaagacgaagttgagttaaacacagttgttaaagatttggatgatgccgacaagaataagaacagagttttgattaatcctaaagacgaggaagatgaatataaggtacccaccacaggccacaagctatctcttaaacagatgttggaggcaactggggattccagtatttcccaagataactttttacttagaaggaagcttgttgacggcagcgagtccgctactatggctgtaccgttacccaagagactacaacaaagaaaagagagagaagccgcgtacgagctctctaaagctgaggctgacaagtggcaagatactgtgaagtcattaagagaagcagagcatttggtatttcctcttcaaccacagaaggattctgacgaagaactagaagagccagaagctaaggaactgaaacctctgaccaaactggaaaccgctgttaacgaagtattgaaagcctcttcattacttgatgacaagaaggaatctacttttgaagaaatggccaccgccaaaatgaaccccgctgaccttcgtcgtaggcaaaacgaattgcgaatgatgcgagagttgatgtttcgagaggaacgtaaggctaagagaataaagaagattaaatctaagacttatcacaagattaaaaagaaggaacgtctcagaactgagcaacttgttgaaggtgatgaatctgatgaggaggaacacgattccaagagggcccttgaaagaatgtccttgaaacacaaaacaaatggacaatgggctaaatctataatcaaaagtggaatgtcaaaggataaatctgttagagatgagcttgaagagactttgagacaaggagaacgtttaagagccaagatccagggagatgaggattacagcgatgctcgcagtatttcagatttggaatcagatggagaggaatctgatcctgagcttagatctaagatcggtaagggagtgatgaacatggattttatgaagaaagctgaagccaaacagaaagcagcaaacaaagaagaattagaaagattgaggagattccaagaatacggccaagaagacgatcttgatgaattccgcaacgagtccacctctgcaaacgttgtattaaacacagggagacgagtctacactccaggtgctgctcttgagcacaaagagatcgaagaggaaaatgtgaaggtattggaagaacacgaaatcgacaacgcaaaaagcttaaccaacaaattgagtaaaacggtacatcgtgaaaaatcaaaaaatgctgaagatgcagtcaaagagtccgaatctcagaatgagaagcaacctgaagaagagaatgatagcactgttaatccttggctgacgatcactactaatggtagcactcacaaatccaagaaggtaagagtaattgacaaagactcatcaaaatcagaaaaagcagcagccaaattgaccaagacaaagaaaagaagtaacgcacatttagaagaagacgggccgatagttgatatgaacgaacgactgaagattgtggatccctatggttctgatgaggatgacgaagatgggtctaacgtccgaatgttcaaacagacagaacttattcgtgaagcttttgccggagacgatgtgatagatgaatttcaaaaggaaaaagaggctatcataaaggctgatggtgacaaagaggtagatttgactctacccggatggggggattgggccggatcagatatcaagaaaaagagacggcgaaagacggtcaaggttgccggcgttgtttcggaagaaagacgaaaggacaggcaattaaacagtgtcattatcaacgagaaggttaataaaaagaatctgaagtataggactgacaaagttccataccccttcgagaccatggctcagtatgaacagtcgctccgtacaccattgggacaggaatggatcactagaacaactcaccaagaactcatcactccccgtgtgattgtcaaccatggtgctgtcgttgatcctttagatgcacctttcaagtaagactagctacataactattgaaatttcaaccagtaaaatccctacaccacgtggtcttccatccgcacccttcgaaaaatttaagttatgtacgcaggaagccagtaagagtatatacctatacgtttcaaaggtttgcacctgttataaacaagagagggcttttggagcagttttccagcaacaatctgaattgtcagacacttgactttttaaacatcacagttgagaaaggttgcccgaaagtatcataaccaaaactatagccgttaaaacattgattacggcagataaaagctttttacttcaacaactcgggctggttaccgcagatctttgtagcatcatctgatttatgatgagtgttagctctaatactgtgctagatagtagcaaacctgagcagttggatccagagaagtatacgaaaacaatccctcaggtcaagaaagaaggagtccatgatatcataccgccagtgcaagttgacacgatcattaccaaagcgggaaaaactgtagataatgcgcatataaaaacggaaaagtcaaaagcaaaggaaggacaacccatgttgacacaagagagtgcgcttggtaaccccaaaccttcgccaactaatggtgattctgtgtcgaaagtgtcagcgtatgcgagattagattttgaaaagtccatgttctatgttcaaactcttcaggtagttcttggtaggaacccagatagtaaccatcatacagttgacgttgatctgggaaatatcaaatcggtgtccaggagacatgcgatcattcactataactttgcagcgcaaaggtttgaactatcagtcttggggagaaatggggcatttataaatgatacatttgttgagtcaggaatcaccttacctctttcccatggtaccaaaattcaaatcggtaccattgagtttcgttttttgcttcctagttcaaagtcaagagagcgcagcaaatcgccatcaaaacaaattaatcccgtagatgctgttcaattaaagactaatctctacaagaacagctccaaagcattgcataacagtaggggaaatttgtcctccctatccgaaactgagaaagacgtttccaagtcagatgacgatgtcaaactagacgaaaggcgaaaactttcttccaacgttttatcgacagccactcctgttgggtcttcaagtagctctactccaaaggcattaaatctttcggtttcaaaccccaatgattttgatgtcaatgccccaacgcgttctggaatttccattgcacaacaggttacagaagcattacaaacagcagcagtcaatccccaatcatatcccccacccattaatcagccactggatgcagtagcattagccaatctaaagaaaaaggaacctcgcaagaaacaacctaaacagccaaaaaaagtttacactttggaagagatcccaccagaataccggaccaaacctgcatgctcgtattcaactttgatcgccacatgccttcgtgctagaagcacagagaaaggtatgtctctttccgaaatttacaaagctattcaggagatctatccctactataagtactgtccagatggatggcagagttctgttagacataatctttctttgaataagctcttcaaaaaagtttccaaggaaggaaaaggctggttgtgggggttggatgaggagtactgtgccgaaaaggaaaaagtcaagaaaaagcaggtagcagcggctgctgcaaaggtcaaatcccaacaagatagaattcaacagcaacaacaacaacatatgcagcaattacagaacttgcaacaaaagtacagtggatcaggaagtctacctggtaactctccaggatcggcaattgcttctccagatataacaagaagcattgtccagaaagctgcagtcggaatcagtgattcgccttcaccaactcctgctactccctccagttctaataatattcaagcacaactggcagccaacagaagtaatcccaatattcgacctgggcaaaaacctaatcagttgtcaagtgacacaatgaaggccctaggatatctccagcaggaattaataaagttgacaaaggatagaaagatgaccgataaggctactactacgacgattctaacccaggcattagcgatgacaattgcgcaagtgaaccaagcggcgaagaatgcaggaatcccaggaaatcccctggcttccttaatcgaacgtaatcctcagcatgtcacaaagattctaaccgcagcattgaatgctgcaacacttcaagtaacaaaagtcaagccacccaacgctactaatgttggaaccagcagcaaagctcttggaaccccgaaacccccgcaggcttcggttgttacgcaacctagtcaagcacgcgttcaaacccctacacaaccaccattcaaagcgcctcatgtgacttccaagcctccacctgttcaggtgccagtggcaacaaatatttctttaaatcagttaccatctccggccgtaaaatcagaagcaaaggattcggaccccgttgttggtgctcctaaagattctccatcgcaatccagcccttcacctaaaagttctgcatcaatgataaagaagccgaactattacgcaaaggggcaaccaggggcttcagctgataccattaacaagctgaaaagacctgaggggttttcaaaaccaaattcattaatgaaacctcagaataacctgggtcacccaaggctacctatgagtttcaacgctcgtccagggttagttgagtcaacacctgcaacacctggagtgagtcccccaaagcctagagcacatcaacctcaaccttatagtaaagcacagcccttaaaaccagtaggttatgtgaatcgtgaaaaagcatcaacccaagtggatgctaattcggttccaaaagttgaccagcataccgttgacacattgacagactcttcattcttggagctgccaccagaattaagtaatccagagctggacaaagtgctggagtcattttcagctagtcctactccagatccaattcaaccaagaaaaaccgatcaagtcggagatgttgactttgataaagaattagatgttatcctatcaacaccagcatctgtaaataattctagacaggcaactcctaccgcagaagttccaaatctgaaaagagagaggacagatagtgacgagcctgagggtaataccatagccaaaatggccaaatcagaacaatagacatagttaattattaatatacaaagcaagtgttaatatcaagcatcaacgttgttaaaggaaccttcagaggctttaaccttccaaaatgtgtcatcaaagtcaaagtttccgtgatagacccaaccactttctgtaacatggtaaagattgatggaaccaccggagtatgcatctctgtgctgggcagccagaatacttctctttcctaggtaaagcgcgtcttcaacggatagatcccatttgtagttggagtccaatacaccgtaggcaaatgtctgacctgatccgacacagaacatatcacctttcagccttgatccgtcagagtctacgtaataaattgttggaccttcttttttggtaaatccgcaaaccatggtacccatggacaagcccatgcctttatattggtagaccaaatttcccaagattttagatgcagcggcgacggagattctctctttctccctaagttcatgcaagcggcattgagtacctagccaggtttcccaatactgacagtcagcggcaccaccagccattgttcctagcagaaacggattgattctaataactttgttcacggtctgagaagcgatccagtcaccggcagttgctctggaatccacggccacgataataccttccttgaacctaaaagctagtgtggtagttccgtgtgcgatcttgatcttgcaatcaggattggatgcgtcgtctgtgtgagctcttaaaaactctgtaggctgagaaataggaggaactgttatggaaggagccatcttcaaatcgactccagactcaaaaaactcattatcattatcttgaaatgcttcatgagcagggtttgtgtgtcgaaattgttgagcaatggagttcataacggcaattcaattggtgataaaagaaggatacgccttatgatttgccacttgatgtttccagtttcgataagagaaacccagatatcccacaccctcgatggttgtgatgctcggaggttagagtaaactgctctgcgcgaaatttttcaaaatcaaaaaatgatgctggggtgtaattctggatcacgtgtgtattagtagggctatattctgtacgtctagaaaggtgaggatttcacgtgacagtctctagcaaatcgatctttgcccttccctctctgtgtccccaattcctctattgagtgcgcgaaacacgaccttttcggtgcttcactctgttgaaaaaaaaaaacttcaacattccttcagttgaactaacgttacagaatcagatacacataagatggtatgtatttacacagaagcacccagacctccgtaaatcggttgcttgaaagactcatgattgaaagacaaaaaaactaacttttcaggcttctaaaactcaaaaccctatgcgtgagttgcgcatttccaagctggtcctgaacatcagtgttggtgaatctggtgacagattgaccagagcctccaaggttttggaacaactttccggtcaaacaccagtccactccaaggctagatacaccgttagaactttcggaatcagaagaaacgagaagatcgctgtccacgttaccgttagaggaccaaaggctgaggagatcttagaacgtggtttgaaggttaaggaataccaattgagagagaagaacttttctgagactggtaacttcggtttcggtattgaggagcacatcgatttgggtataaagtacgacccatccattggtatttacggtatggacttctacgttgtcatgggtagagccggtgccagagttgctaagagaaagagatgcagagctaagattggaaacaaccacaagaccaacaaagaggacactatccagtggttcaagcaaagattcgatgctgatgtcttggacaaatagactgttcatagttgtatgattggttatagcgaaggtgtgttgtctagtagttgtatgtaagctttactaaaattatatcacctgtctagtgacgctaattctattctggcacattccactccgtaatcgacactagatttgatggactctttccatgatttgttgagatgctcgttcagaggtctaaaatcaacttgttgcctcttacgtgagctattaatccggtcaactagctttcttttgtgtgctatcgttgtatttaaaccttcttgtagaatttctaactgtgaattgttgatcaaataaagattgcgagtattctctcgtaataattccagggaacgatgatgaatctctgtatatgagatcagggtatctaactgatcatttgttttagcttcctggtatcttgattcgcttatgccgttgaatgtgaatgttattttatcttgaagactatcaatttcttctaagatgctttggattgacgatggaattgagggaaacatttgagcaaccttgggatgtaaatttttcatagatttgagctccagagatatcaaatctttaaccgtgttcagttcctcatcagttggttcattatcgacattagacagataatcaaacggctcgtaatgtaataatggcatcaatatcgtctggttgttcagctaaatgtatagtccgtgagatataggatatggtgtaggggtgtataataaaatatcatgggcaattataatttcactgggtggaagagaagtatctattcaactcattcagagctatacgtttgaatcaacgttgcatttatctttcacaggagctgaaacttctatagtttatagccattgtttagaaacactagacataaataggtggcaaccttccaatcgtataacttgtgggtttggccgagtggtctaaggcgctacatttaggaagcattgaatcctgtagtatcttcggatgcgcgagttcgaatctcgtgacccacatcatttttttcatctaatttaaagatgaatagcgttactacctgctaaatcttacgtcaagaatcgtgacttgaacatatcgttttagtcccagatctagtcgactcgctttgacttctaacttcgttactaaccgtcgtcgaattcttccggattgccggggtgtttacatctccgatcggtattggtcttctgcgcactaaaatcttccccgaaaaactgacttttaccccaaaacacccctgatggatagcgatgttattacacgtacaaggaggttccttcaacaggatgttgttctttctttcctttctggaggcatagctggtgcgttttcccgaacatgtgtctcgccaatggaaagggtgaaagttttgtatcaggtccaaggagttgatactaaatcgtataaagggggagtattgaaaagtatacttcaaatatggaaagaagaagggtatagagggcttttcaggggaaatggaataaattgtttgagaatttttccttactcatctgttcagtatgccacctatcaggagatcaaaccatacttattagagccaggtcagccagaattgaccactggagccaaatttttcgcaggaaacattgcaggactggcatccgttacggcgacttatcccctggatttagtcaagacccgactctccatacaaacggcttccttgggaaacctgaaatctaagctccacggacgaacgaaacggccaccaggaatgtaccagtctatcaagcacatttacttaaatgaaggtggagtaagatcgctatacagaggatttgtgcccacatctattggtgttgctccgtatgtcgctctcaactttacaatctacgaaggattaaaagagttgttaccagggtcataccaagtacatcatcctgtagttaaactcacgctaggagctctctccggaggaatcgctcaaacaataacatacccttttgatttacttcgacgtcgattccaagtgctcactttaggtacaggcgaaatgggattccagtacaattccactggacatgccctcaagactattgttgcccaagaggggtacaaaggattatacaaaggatgggtcgccaatatgtggaaaattatgccatcaatggctgttcagtgggctacttatgatctgatcaaggagttcatcactgggctataataggagacgaaacaacaatagaacatccagcatccatcaccctcatgcaccatcagagctagagtatcggtgcgcgaaatcctccatcagccaataactctctcccttttctcacaccatctcttcataactatagttacataaatttatcaattctaatgagacctacacagattaactttgctgctgcagtaagtagaattcagagaaatgagttatgacagagtttctgttttagtggctccatttactaacaattttctcctttgcagaagaagaccagcttcatcagaaatatcccagttgagttaacaccactgtttatcgccactggagttgcttgttgttccgccgtttatttcactaccaagaagttaagaaccgacagaactcttcgtttaggtcgtaaaaacccagagttcaacgaaaagttcgaagaggctgtcagcaagaacgagtaattctatcatataccttgataattattccttaacatattttattctattaagattgcttctttttgagattggtaaaataatcagtgacgtcgtcaacgtcgtctaagagctttacaaatttgtcataggatttctggtgatcctcatttgtgatttcgaccaaagtgtcttcgttgggcttataaccaatagaaacttggtcaattttgtacatggattttaactctttggcgagtcgtcccgtatcttggggatctgtcacaacttctacgagtcgatcattctcttcgtcctctataatgtcttgagcacccagatcgacgcatttttcaaatacgtgatcgatgctatcttctcccttatcaatgactatagaacctttcttctcaaataaataagctgttggagtcaaattggatccaaatttggtgaagcaggctttgacaagacctactgttctagacttgttgtccgtcaacgcctggacaataactgaaactcctccaggtgcaataccttcatatgtacattgttccacgttattcttgtcccctagctctccagttcctctcttgatggcattctcaattacttttttggttacgttctgcactttggccttttccagagcggtggccaatgctgggttccctacaacatcagctccacccattttaacagcgacagtgatttgttgagacatacggaatgatattctgttcttttccaggtcatttttagccttgtcatgtttaatattggcccacttactgtgacctgccagggcctttttagtagtgcatattcctcttcgaagtatcatggtatgtgacaacagcatcgttgatgagcagtactttggagattaagatctgatatctacctctgcgtccttcta

SEQ ID NO: 115 - DNA, 483533 bp, Pichia pastoris
attggagtcattggagatgaagacacagttaccggtatgctgctggcgggtgttggtcaagttacttctgagccgggaaaggagaagaattttttggtagtggaaccaagaacctcagatgatcaaattgaagaggtctttgatcagtatactgaaaagcgagatgatattgccatattactcattaaccaacacattgccgaaagaataagattcaaggtagatacattcactaaggcatttccagctatattggagattccctcaaaggaccatccatatgaccctgagaaggactcagtgctgagaagagtacgcagactctttggagaataatcgaaaaaaccattactgatgcagtattttttagtaatctacactctactttagaatatatgttatcatttcttgcccttcttcttcttcttcttggaacctttctttgagttaggttgtaaacctaccagcgctgggcttgactgggcatgtgaaacatcgtcctcctgctcttccgtttccgagtttagatccccagcagggacttctggagcttcattggattctaatcctttcgtggcatcaatttcttggttcagatcttcatcagggcgattcaaatcaactggtggttcgatcgtcggcacctcggtaggggtttcttggatatctggttcttcaatgggttgattgttggcagttggctcctcaacggttggctcttcagccacttgccccacaacactttcggtcttagtattgggatcatcgatagatgcattactcaatgtttgatcaagtactggttcttcaatcgtgggatcagtcaccacaaccttttcatacactggctcctcaatcgtaggatcgatggctgtaggctcttgaaccactgaaatttcagttatattttcagttggggtcttagatggttctccagttgactcttcattcttcgattcctcacttttctgctcttcaatcactggctcctcaatggttggttccacaatagttgtttcttcaacctctggcgctacaacaaccttttccacaattgttggtgcttcaatttttggttcttcaagtttaggctcttcgatggttggtgcttcaatttttggctcctcgatggttggtgcgtcaattattggttcttcaatcgttggcacctcaatcgttggcacctcaatctttggctcttcaatctttggctcttcaatggttggtgtttcaatctttggcgcttcgatggttggtgcttcaaggtttggctcatcagttttggactccacaatagttggatcctcgaccttagaattgtcagcagttttttgctcagatgtttcaccagctataggtgcttcagattttggagtttgatgttcagttttactccaatagttcttctgagtccatgcagaagtatcttcagcatttacatagaagtttctcacaccaataatacgtctttccaactcacaagctttaatccattcaggtctaacgacaggtataatcattttttcagccttctcccattccggtccaacactctttgtgcagataaaatgcgtggtatcgactttaacttctctctgcattggtcgtgctccaaccttacgaagactctcttcaatatcctcaattgtaaacgcatcgttgggttcaatctcaccaacacaaactgtaattccacttaaatcagtcatcttgtgtgttctcaattgaacattgttggatgtgtaaacaccagctgtggtagtcagtcgtaattggaactcatatggagtatcaatgggtaatcctgacaattttgtattagtgttaactagtggatttgggatctgacctaaccgttcgccatttttgtataaagtcaatgatttgatggaagatgtacctaattctagtgggtcccattccaacacacaactagtttgggtaacattgagaactctgagaactggtgcttgaggtgtgttcttgccaaaaaggtcgtaaatctcttcctgaacttgttcaaattgttccttctctttttgttcctcctctaaattccgatcacaagtgattctaactatagatcccgcggtgataccatctggtaaaagaatcgtgggaaactcaattaagtgatgatcttttgtcagaagcaacgccaaggaagcgtctagctttccaaccgtcaatgagacttgtaccattgtaacgtgatctaagtaaaggaggaccgggttgcgaaaagcttctagttgtagtctgtcaagttgaacgaacgtaacctgttaattaatttggatggatcgttcgcgcgtgtcctcatttttccactcaaggagtagggtagggtcttggcttaacacatccccgttctcatacactagcaattcaatacgaataatttcataaacctcatttggctaaatctaggtatgatcatcatctatggttaacacatttactggctctcttgaattgagtgccagatagctttcggtatgccataatagcattcgggagattattccggagaacatgaatacactttcttctctgtcctctggagtcttttcggtgtagaaaagaagtaacggccaactatgaatatgtgcttcatggcagtctactttggtcctcccgatacctttgataagctttgaaaactggtctaattcgggacggaaatactcttcgctcccgtaactgagaatcattcctgctggagggaagctcttagcccaccacgattcatctgtacaaagaccagggctatgataaccatctttaggggagtgtgtgagctgatctggaatgaataattttcgccattgcgttattagctggggagtaatgtagtcagaattatggtttccctcactattgctatcctgctccgtgatgaaatagtttagaattggagagatgatgagagcagtatcaggtagcttcaaatttgcgctctccactttttctatcgactttttcgttattttgaacgcagaaggaagtttatcatcgtcatgtttatctgcgactaatccaaggggtgaaacagggtgtggtggtacagggcaattggcatcctgggcatcatctatgttactgaaaattgaaaaatctggtgttccaataaacagtagcaagctcaatgctatggtggccccagttgaatctccacaaagtaccgttcttgctgagggattggactctgtaatatattgccaacctttcaagacgtggaacaatccacggggaaacattgcatcaggtaccttaggaagttcaggaagaaatactgcaggattttggaacccctgttgttccaataagactaaaaatgttgacaagaactccacatagaagttggggccaccaacaataaatgcaccatttggaatgtagtacaatatcagatcatggttactgttggatctgctttttgatttaatccatagtccaggaacaggttgcaatgattcactatcagagtcattggacaacccgtctacgtttccataagagtccgaatatatgatatcgcccaaaccttggaatccctgcctgtatgctcgatacaagtagaaaagtcggtgaactcttggggaaaaaaatactgtggaaggatcattgggagtatgaattgactccagactatgcttgagggctttggagactgtgtattccatacaagtgcatctttgtgaaaaaggaggttggaattcgaatggctttacgattctgttcagaagcacatctagtggaagaactaagaagtcataaaacgctgaggaacgtagtagagagagaaaggctaacggccctgattcggtaattatacaatacaccgtgatgaccaaatatactagtatatctaagttgctgagttcctccattctgttagtgggaaagaggagggaagaactcagaatgagtcgagtacaaatagttaaggagccgcatcagaaaagctagtttatcgaataccacgatccttgcatcaagatgcactctacagctacagcacttagtaatttgtgtttttgacactttaatatacatgtacagaataaaatataatgagcttagttctgagagagaaccttgtcgatggtggcaaccaagatgtcagcgtgcttcttgccgaacgtcaaggttggacgcagacggatggagtggtcggcacatccaccaacgttaacaccgttcaacttcattttggccaagaagctgtttctagcctcagaagaagatgcatcccaagcaatgaatgtagctctgcccttaccacgaagtctggacaattcagtagggtattttttagagagttcctccagcttaccaaacaagtagtcgcccacttccttagcattagcaatcagattcttgtcgacaacttccttggcgatggcaccggcaatgatcattctggcggggtcaccgcaccaggtgttgaactgtctgtatgagtagtttggaaccaattctgggtcatggaaaaagtaaccggcagattggaattttttggagaaggtaaccatgtctggagctggagacaggttgaaatgctcgtgagcccacatagttccagtggctccgacaccggtttgaacctcgtcaatgatcaacaaagaaccgtatttcaaagtcagatcacgcaaaccttggaagaaagctgcagaaccgtggttgtcaccaccctcagattggattggttcaatgatgatggcagcaatcggtgcatgccagttggttaaaatgtcctcgacaatggccaagcatctcttgtcttcagcatcgttgtattcagcattgtcatccagagggtatttgtagtctggatattcagcttttggccatttgaaagatggcaagtcgatcttgtggattggcttggagcaagttgcagaagcagatgcaaaaagacgaccgtggaaagctctcttaaaagaaaggatggccaactctggagaacctggagactggttcaacatggtagttgtctcttcttcctcggagaaactagtaccataacccctcttcttagcctggtagtgcataaacgcagctttgaaagctagctcgttagcatcagcaccagagagtccagaccatatcttgtcctggcccttaggagctaccttcaaaatgttgtccaaaatttgtttgaagtctttacctggaaagttacccaaagctggtctctcaaccaaagcacggatcatctctggagactttgcggcctcaatcagagcaggattattgtaacccaaggcaatcgatgcgatttgagcgtagacgtctaagtagacgtttccatctacgtcagcaatgtagttaccattggatttttcatagtcagcgacgaagtagactggtctggtgtcgaaaacggtggagagttcctcagtttgcttcttcgactcgggtcctgggatgactgaagtctttacaactggagcagttggctcggatgggtagtaagtctcagaaacagacattaagagttaattcgatagtaagagggatcagcaagagactttaagagggcttttatatcccaagaacatatccgctagcggtgctgttatcatggggaagatgaaagattatatggaggaggagggtaccatctactagcggattgccaaaagaagtatccgctcatatcccgccggcggattactcgatggaggccttttatcttcctcgacggcgacatctggcatcggtagcgaggaagaatgtaaggaaacagataaaaagaaaaaaaaacattctcagtcaaacgacctgtctgtgggtcaggtgaccgatatctaagcttttccagatcggtcttagagctgcctaaatgacaattgccggaaaagcgtagctcaaataccgtctgactcatgctatcatgcaactatcattaattataagttctacattcattaaggacataccgccgtctcgcgccagtgatctccagcaagtcttcggtatatcagtcttctgccttggccgttgtaaccaatatctacaaagtcaaccttatccacaaacaaaaccaccactaccaaattctctagtccatcctcgtcagatgcaccatctacacctcttccgatggaatccagtagttttattttctcttcagtcaatctcgagcccggcgtaggcttacggaaagtcgacttgatagaacgggagagagtattccatattctgcgtcgttcatttttccattcctcttccgttggtggagtaagttgggcagagatctcttctggatccaatccttcttctcctgaagatgcctctagtttggctattacttcaggagataacaatggatattccagctcatcacttgctgtggacctggggaactttaggtagtcaattttgtctgtttcaatctcgttgtcattgtcagctataagggtgacggtggcctctgcagagttcttaagctggtcaaaaatatctggtggaagcttcagcttaggcgtggttgtgtcgtcaatacatcgggcaactcctctaaggcggaattgtttcctagcaacatgactataaaaacataactcaaaagcactatcgttgaacagctctttgtacttggtcatacgacgatctgtggtgaaagtaagcacattggtgcttctgtcgtcaaataggaatccacggtgaatgacagttctgacatgaggagatccgtgttcatccaccgttgcaaactgaaacgaaacgaatggctgtttctccaactcacgggcgatgctgccggccagagctggggcccaaggggccattatctgagtaggcattggtgctatcttgggagtcgatgagaacaatcggttaaatatagaaaggggtaaatggttgtgtgacaagaataagccaaggtccacgttttctgtgggagagaaaaattaggtgcagggatcagacgagcatttggcatcctaattaatttttttttatttttcttttttggaaggatctgaaggagtggatactccactgcagtagccaaagaaggataacatacgagatgataatacctgggtgaaaaataacattataaattagtatctactgttctggaaatttatgaaatctcttttagcctctggacagcctttccatatccttgtgtagccgctctctggtaccaccttcgagcctcatccatattgacagacgttccgatcccatactccaaaaatcggcccattgcatattgggccttcggaatactctcttcacaggccttacgagcccacaggaaagcctgttcgtcactttgctggagaaccccggaaaatcctgtcaaataccatccactaagtccgatagccgcttggcagtcaccttgactggcagctttactgtaccaatagatcgatttcttagggtctttcttcagcccaaggtttccaaattcaaagctgtgtcctaagtaggtttgtgccttggggtatcctagttgtgcgcttctcagataattattataggctttggcaaaatcttgttgtaggttttgttgatttagaccttcgaacacctctctgctctctctaacatgtttgggactatttccgtaacccaatgaggaaagatcacgttcatataacttagcaaccatgtacaatgaagctccagtatccttgtattcgaggtctagagaatctgcttccctctgaacctgttgtcttttcaatgattgaaagtattggttatcgatatcggcggctttaaatagatattctaaagcccttccgacatctctgggttgagctaatagccccttgagatacactaaacccagtttgcacatggaattaacatctccaaattcagctgccttcttataaaaatgtagagctctgcctacgtctctttgagacccgactccaaattcgtagcagcacgccaacctgtatagggcatttaaactttctccttgcaaagcggccaaggcatagtaatcaaaagattttccataatcttcagaaattgtacctttgaaaattgcaccggagtaaagatagcccaaaaatagttccgagtctgttcggttaggaaatgtcttactgatacttttgaagcgtgcaattgccaattgaaccatagtcgatttggtctttttgagttctttcaaactggcaggacgcggtctcaccctaaagtcaggcaaaacgttgttcaagaaggttggatttaaacaacattcaagataagatctggcatattcaaactgaaattgtggatttgctgggttttgtctagctctttcctcgacctttctaaactcacccacaatttctgggggtgatagacgaggatttcgtaatactgataacttggaagatattgacagacgttcggcctgccgtatcgaactaggagcatcatattgaaccctggatggggtatgaattcctcgattatccagttctttagctacttcgtcggtgtatgatttagtaggtttcgtaggtgcgtgttttacatcctgcaattgaatatcctgtagctgttttcgttgtttttctatctgttcaatttcatactgtgtgtgactgtttgcgctattcgttggtcttggaagggatgtagaagaagatgtgacccccaaagaaggcggaggtatccttttatgagagtgaaccggacctaatcccttttcgttataccgcctatcgatactctgatctgtaattgaagcactcctcaagtcttctgctgagtccacagcaaaatctatcggctccggatattttgacaaatcttccaaagtatgagacgatggaatctcgcctttgtacgggagggcagggggagcaacatctgctgcagttagagggggatgttgtttaagtcgtctgtgtgtaagttctctacgaagttgtgatctttgttgtgaaatatcatctccgtaaggtgtggcttccatagtttgtagatcatcattgtcatcgtccactggatacatggattttgaagtcgctactggatcttgtaccatttcatactccagggctttgagttctagttcctttcgttggcgttcttgtaactctttctgttctctcatttggcgatcctggagttctttgagatctcgttctcttttctgaattctctctaggttaattctttcttggttgattttctcctgcctgattctttcttggttaatcttttcctgtctgattctctcttggttgattgtctcctgtctaatcctctcttgatttattttctcctgtctaactctctcttggtcaagcatttcatatctgattctttcttcattatttctctcttcattaattcgttgttggttaagcctttcctgcctattgcgctcttgaatcattctttctcgattaatcctatcgttgttgaacttttcctggttctgctgctcataagccctttgtcgattaatccagtccgtatcatcattttgttggttccttccataactcccgtcttgtttgttactactctgatcgcttgatcgagagtctaaatgagaagggagaacaggtaggttttgcaacttttgctggatgatacgctgatggatttgctgagagttaagctttcgaggctgatgtcttgcttcttgcggttgaggatatcctacactaccttgttgaaaagcgtcttccctagggtagtccccgttgtagctgggttgctggaaattcgatggaggtttggattgatctagcctgtcaaaggtaccacgtccacgatccatttgagagccatacacgctgtcctccgaagaataacctctgtaggagtttgattgattgacaatttccctagaagactgactgcttcctcccgaatattgtggacctccagtaggcggaggattatagtatggatttgcttgatatctggaggaattctgcggatcgtttccatacttgattggagttggattcattgataaggaatgcggaggaggaactttgactggatcatcaatctgctggaagttgtgttcacccgatggtttcttgtgtctctgaaacaagttgggcatatagaggatgatgggggaggtgtagaagatgcctagttcagtcaaaagaaattcgcgatttccccaactacgcgaatacaggacgtcatgtgatccgcatgaaaaataacagaagacaacctaaaagggcgatgcacgtatctcatcctttcaagctccttgctagcaaaaaaaaagaggtaaaacaaaacaccaatgttacaagaacaatctggagcgagacctaagagccaaagattgggccacagagttcaaaaagaatcggctgaatcgcacaaaggttcccgcaaaatgccaaactccgcctcagtactggctactgtgacaaacttgtatccaggcttaaatgacatcacagattcgttcgaagcatttcccctggagttgattcggtactttaccttattgaaggagattgatgctaaaaccgtgcagtctgtccctctgctaatcacttacatcaaacggttcttgcaaatgtcaaaaacacacccgaaaagagaacaattgctccacgagatacgagagttaatcaaagagctaatgccctgtctggaagagaaaatgcatgtggccactattgctgccgacgctgttgcaagacacgtcaagcgtattgatagtgactttgaactaatagtggagaatgaaatcccagcagaaattagaatcggctctatggatcaccatcctgccatgatacacgatactaagcctgcagactctggcaagtctgcacaatcgcagagatcagaatctcgaagagaggcgctggcggctcgtaaagcacaagctggatctaatggcgggtctggcattgacgccagtggaccgggtgatagggacagagcttgggaagactgttagaaggcgtgcaaatgcaaactctacacactctgcaaaccacagcagtaatagcaataacaacacaaacagtatcaacaataatgttacgcatatgacgaataatagtatgaccgctgtgccagctagccaaccagatgacaggaggcgaggcggccacaagacccagccggaagttagagaaagcgcaacgaggagacgaccgggccaaaataacgatttatccactgaggtgccctcaaatgccaaggaagacaatgacgaagagcctgtgtattgttattgtcaacaggtatcttatggggagatgttagggtgtgatggtatagattgtaccagagaatggttccatctttcatgcattggtctaactcagcctccacgaggcaagtggtactgtgatgaatgcaaattgaagataagaaagcgatagaaggggggtttgtagatgatagatctttaggaccaggggctgattcttcaaccccacaatgtcatgtattgtacatactggttttttaccctctctgtcgcgatcgtttttcagtgaaagctggcctcatgactcctcttacatggagataaggcaaggcgtttataagatgtagtgacctaagatacataagcgggtagccttaattgtgaaaaaaacaataaaatgcccatcgcatgacccgtctacgcatcgaagcttcgaagccatttttagatttctccagggcccctcctaaccccccccccccccacctaaatccagcaccgcctcctagcctcaaatggcaggcttctaaattaaactaactaccactcatttaaaaagttcgcggtctggtagcaaactggcaaaaaaggcaagaatacttttcaagccattaacaaccatgtccgaggattacagattagtagtggtgggtcctccgtcggttggtaaatctgctctgacaattcagctgatccgtggagagtttctgactgagtatgacccaacaattgaggattcctataaacatccctgcgagatagacggcgcgccggtaatgctggacatcttggataccgcaggacaggaagactactcatcgatgaaagaattgtatatgaagacgggggaagggtttctgttagtttttgccataaacaaacgatcatctttggaagaattgaagcctttttacgatcaaatagtcagggtgaaagaggggatgcaatcagtcccaatggttctggtgggaaacaagtctgatgttgaagattccaagagagaggtcagtcgagacgaaggagaggctttggcccgtcaattcggttgccagtacatcgagactagtgccaagaccaatactaacgttaaagaggccttctataatgtggtgcgagccaccaaaagtattaaggatacaaaccaaacaggaattgacacaagtgtggatcgttcaaagaaccacgagaaacctactgttcggggcaatgccactgcccctgcgtcttcgtcagactcttcatcatcgggatgttgtatagtgatgtaggtgaagataaacttcttatcgacttctaagttttcattcattttaactctcctattctacggttcagcttcgtaaatcagattagcggccttgaggagttcctcaaccactttggccttgtagctcatatcttctgtgttggcgacctcagagtacagcagtacttctccccagacaatactcaaagaccgtatcgtcatacggttgacatcttggtgtgcggctattttgttaagatggaacaaaagtgagcgaagcgtccagtagggaccgtcgggtaattcataagctatctgatgtaatctcgttgatattttggtgctgccagaatcatcctttactgcgtccaagaaatcctggtataaggcattcgtgagaagcggttctggaagcgacttgaagaacagctttaagatggtggcagccacgtatatgtcatcatccaatacgtgatcagggctagatggaccaatcagagcaatattagcaggatccctatcaattagttctcttagctctttaactttggtcacgctcgcactcactctgtaaataccttccaaatctagtccatacttttcaatcacctgaatacattgtcgcacaattgcaggcaccgatccagtgtcattatcgaccagcacatcgatcggtaccccgaaagtagcaagattttgcttcactcctggaggcacggagactgttgaggctgtctctgatacttgtagctctctcggccccgataatctacttccaacaaccttggggtccagtgtgggggaataagaagtacttgcaggaagaggtgacaatggtgaactagatgccgctccaacacctgcgccaacagcagcgcctgccacagctccagatgtaggcgtaatgtttctcctttgggagtctttcctaagattattccccaataaaggatgcactttgtattccactggggtcagccatctattaagagaagtagtaccctgtttggtcaaaaattcgtacaagtctttctcattatcaacactagcagcaattttcttgattgaaggcttattagaatcctcgtgcaaaggggatatcaatataccagacctcatcacaagcgtttcgttccatgttgtgtatttctgtaattgcaatgacattgcggtgtcaatctccaaaataagacctttcagagctttgacctgagcaggtctgtgaaccatcaataattcgtctttcaattttttgcactgatggacttttgctctgtaatcctgatccgcaatctcaatcttacgggaaagttcttcctcctgttgtgtccccgtcttagatccttttagtgtgaaggtcttctttgatggatcacccgtgcgaagcttctccaattcgttacaaaagttgaaatacttgttttttgacttttctgcagcagcaatggcgtctccacattctctctccttgcggcgatattcttctttaacagatttacgagatttcgatacagtcgaagctagtgatcccagttgctcgtacatcaacgtcaacgccttaacatagggtgatccaacgttgaacaactcgctatcaaaactaacaattttctcaaaactgcgttcaaatgaatcggtcttgaacttctttccgtcgttctttaaagtatcttgggtatgtttagagatttttctcaactgcgtgtaatgatcgtcttccaatattgatttctttttgatataacgactgaactcatcacatgttgtgatacttcgcttgagacgatctaaaaggatatccatagctgagtcggattgcaatatcttggcaatctgggggtcctccaacaaagaagcggaggactcgacctttgcaggagtcgttggactcgagaccgcttcgagttcctgatccacagtgcccaaagaagtgtttgggtccgtggcctccgaagttgattggtctatgcttttatctctggaatccatgtatctattgagatgataggtatattatacaaagggagaagagtacaaatatgtacatatatttccttacgtagcagtattcggtatgtgctcgcgcctccttccagcaggtttatttttgttgaaggctgagatcgcggtgtgatccctgcgttcgttatgtgatcggcagaataaatgtagggtgtccatgaccagtcaggttggctgtgccctgtgatcgtgggaaagcaccatgttttcgtccgaacacatctggatgttttgtacctccaagcatttcactagttgttccacagatatcctcgttgaaggagctggatcaagcatagtgctcaaaatgttgaatacctctccattgttttcaacttccgaagacccaacccaaggcagtacaaactttctagaagcagactcaggtgtgatgtatttgtaataatgagagtctgtagaacgagcactttgccaggggaatttgtccatcaaaaggtataccaaaatcatccctgctgcccaaacgtcaacgggtagagaagcgtactttaccgaagtgaaacactcaggagcagttaatgtctcagaaccaactaatccgtggcaataaacactagcagtactactaccgaaatcagcgattttcaggacaccgccctcagttattagtaggttatccatcttgaggtctcggtgggccacgccaacttgatgtaagtgttctattccagcaagcaactgcccccaatagcataatcttgtctcccggtccaatttattgcgaacagagtgcctgttctgacgtaacagtttccataaagtcgtcgtgcaagactccatacaaaggtgcactgatcttggacccttgacaagatcgaacactttgactacatgttgatggggttgtaaactaagcacaaaaacgaattcacgtagcatagtctccacagtttcttttgagttgtctaatccgtttttgattgcaaatactctaccatcgaaggttcgatgttccatgacagaaccaaagctgcctttccccaactctctggttgcaaccccataccttctccttatataaaacctcgccgagacaggtgtgcatatttctggagccattccacagctcacaagggccaagtcaacttgcgtcggagaggcaggagtaaaagttgaaggaggggggtacagaaaaagaaagtcagaaaataagaaaaacgacaaaaaaccgttatcattttcctccacagtatctccacgttttttcacgacatccctaaaatgagaacccctaccataattaaaagctctagaagtacacccacatctccataaatatgtaaccactgttcttctattactatttaccgctgtatattactctactgtcatataaagtttgagttgtgtccactactatcccatataaactctcgatggggatagatattgagttcaaaaaaagtgactccagctagcagcttcctcgttttagcaagatgctttgaagctattcacctacttgcttgaacccattcaaaaggtacctgtcaacaaaaccaagaatcattcaactgccttcttttttcactcacatgacataacaattcaaaaattcaaacaataagtctgcactgccagtatcgcttaacgcagcaaagcggcagaaaattacagtattcttttatggaacctccacgtgcaccccattccatcatatccgtcattcacaaacaagttcatccctcaaatggaagtagtaaacatcagttttaatgtaacaatgtttgcccgccttggtggcattttgccagatctcataatcgtagtcgtagtcgtagggtgaccaatcgtccataatctcgttgaatcttccccaatagtgatcatcctgtagataatgcggaccaacaaatccttccaaattatcgccaccggtggtaaggtctgtcatttcaatgttcagtgggccaaacacaggccgctccacccgatcatggagaatatcccaattccagtaagcagccatagctctgataatcactaccagattttcaagtttcatatcatggttgtctcgttattgcctaggctgattaactaaacaataatgagactaagatcaaaaaatacaaagaagttaagggtctgaccgggaatcgaacccgggacctcttcctccctaagaaagaatcatacctctagaccatcagaccattcttgcgcgaaataatataagtgaccaatctatgggattaggtaatctgagtttaccagacctattgttatcttatttacaattaaactaaggtttctccaaacgcactcttagcgatggcacaaccagccgtgatggtatcaatttcgtgaacgtcagttgatgccaagtcagggttgcattctacgatatctaacgctcccaggtttccagtctctgcaacagcttcgacaatgtacatcccttcacggaaagtcagccctcctcttacaggggtaccggtggcaggagtgaataatggatcaagagcatccacatcgtaagaaatatgcactggtgattttcctgtggggttgattctagccaatgccatttcaaccactttcgcaattccgtacttgtcgacatggtacatagagtaagctgcgatgcccagttctcttacacgtttcttctcacagggatccaaatctctcagaccaatgtaagcaattctgtcggcagctagcttgtttttggcttcatccaaccacgaaaactgtttgggccacacttctctactgagccccatagctaaggcaactgggaagccatgaatgtttcccgaaggtgacgtttcaggagtattgatgtcagcatgagcatcgatccataagacgcaagcatccggattagcatcaagaaaacctgctaacgtggatactcctattgagtgatcacctcctatggtcagaggcaatcgcttctgatgggaaacttctttaactgcacggtagactctctctgtcgcttgggctaccaccgttggtctctttgcaattccgtgcgatctgtcaaactcctcctccaactctgatgggggtacatctagaccggtacccttgagaggttccttaatggaaaccgaccagcctaaagcttccaaatcttcccgaagtccatgtttcagtagtaatccaggacctttctcaacaccgcctttaccttgaccagcgctaaaaggggcgctgatgatggtaacttcctttgtgggataaaatttataatcaatctgtgttttcattttcaagtacgccttgagtcgggacaagtaagggaaaactgataatgctttatatgtcccgaacagataaataaacagagcggttagtgttaatccgggaagctgatagcgagcggcaccgcgatttcacttctagcatgcaaacacgaggtactcaatttagcacaacatggggagggaaaagaggagaccaagcttggggtgcgtaacgaagggatattttgaggcaattttgatgggtgttggccatatatagttatatttgacgttgctgagataggctttacaatttgatacgataacgtatgtattaaagagaacaataggagttctataattgttccgaagaccgttactgggtatttcatgggattctccgaccacagctgtatcctagtgaatgactaaacctaaatgaaactgcaaaagataggggaaagggccatgacgtttatgttacagcattaatatcaatctggttatggatagttggcgtcactaatatttgtgtaaactgctctcgctatggttccagaaaaaaactattttctgattaatttgttaaattgcaggtcacttgctaattttcttagttaattaaagccaatgttatttaatatatataagattggaagacattctttcgttagttcgaaagccatagagaacacttcttacctgttatgtagctctgctaccaatggaaaacaacaaagggttctgtggtctagttggttatggcatatgcttaacacgcataacgtccccagttcgatcctgggcagaatcatttttttaaattttgaatcgcgccacagtaaggtttgatcaattgattgtttcaggcgtatgctacaggtgcgtagttgtgacgcagagatcatgcatattgattcttccttccagatgagaaagccagcctgggaaatcgcagtcatgtccagcattctttggcatagcaagaattcaaaagttcagccaaatctctctcagacagatatcttcgttgtggctcaagattcaagagcaaaatttggcccgtgaacgagtgcaacccttgcactatctgtttttctttttcattttttttcgccaatttcctgtttggaacaatttgtcgaggcggacttgccttgcagcccccaattccagtgagaccataaaaagcggaaaaaggccttttacaagtcatcccagcaatcgctattccctggcataaagagctacctgtttaaccagcagtacaagtcgaattcgattcattgaaattgctactgtttgaacgatccagttagttagtggttgaatttccctccaaaatgccagagaaaaagaaacaaaaaaaagagtcgacatctccattcaagggtaacctagttgggatctcattggtagctgtggcattgtttgccatctaccagtacctctacccaagctcgttttcctctcagcctgaaaccccagccccagttttcgatctgagcagtgaattagaagcattgtgtcccgtgtaccctgcagtcagatcttccgacttcgaaaaggatcgccccatcttagagagaattctgaacgatccctcatttagaatcgcttctgctcaaaaactgagtaaggctgttcagatcgatacccaagtgttcgacgaacaattggacgtggctcaagaccctgaagtttggaccaaattcgtcaagttccatgaatatttggaggcaactttccccaccgtttactcccaattgaaggtcgacaaaatcaacacctatggcttggttttcacttgggaaggctcagaccctagtctgaaaccactcatgttcttggctcaccaagacgtggttccagtccagaaagatactcttcaggattggtcatatccccctttcgaaggacgtatcgccgatgacagagtttggggacgtggatcagctgattgcaagagtttactgattgcattactggaaaccgtagaattgctggtagatgaagggtactcaccaaagagaggtgtcatcctcgcatttggattcgacgaagaagcttcaggtacctacggtgctcacaatatctccaagtttttgcttgagaaatatgggccagatagtattgccctcattttggatgaaggtgaggctgtcagttacgtggacaagaaacaaactaccctcgttgcaaagattgctacgcaggaaaagggttaccttgacctagaggtcgcattgaccactgtaggaggccattcttctgtcccccctaagcacactgcaattggccttatttccaagttggtcacacatatcgaagatcatccattggacccagaaattagtaccagaaatcctctggtacagttttcgaactgtcttggtgcagctggggctttgagagatgacttcaagactgctcttgttgcatacagcaaggatccgtcgaacaacattgtcaaacaaggtgtgattaaaggtatttccaagattgcatttttcttcggttctttgattaccacaacacaagccaccgatcttattttcggtggagagaagatcaatgctttgcctgaaagtgctagagtagttatcaaccatagagtggacgttgagcgtgattcagcccaaatcatagacagattgattcacttccacgttgttcctattgccaaggagcacggtttcaaggtcacttacagtgactatggtagtgacaaagttgaaactgtctacgagccagaaggagttgcctcattgggagaattccacgtttctcctttctccagagtctgggagcctgctccagaatctccatccgacgacaatgtctggtccatcatttctggtaccactcgtacgatatttgaggagtttgtggacccctcggctaaacttattgcaagtccatacatgatgcctggtaacaccgacactcgacactactggccgctgacaaagaatatctatagatacgttccaggtattgtagatatttacaaggctaagatacactcggtagatgaatctaccgaggttgatgcccacttgcaagttatagctttctaccacgagttcatcaaggttgccagcgaatgggagctttgagtaaccaagccaactcggttgtaagtaagtagaatgagtgtttttcaatttatgccgctgctcttgagcttgtagctgccgctgggaactactttgtaaagactcctgactccttataggtagaacgttccagacgcaatgcagtgttttgctcctacagtagctactttagtcgaatcttttcttttttttcagaaactgttacgtatactaaatggaacaacaatggcttatttgtctggaataaaacggtacatactcagaggaccagcctcggtacttagcaaaataaaaaaaatattaaaaaaattgtcgtaaagtcgttagaatgagatgcatgtatgtacaggatgtagtagcgacagccaccagcaagagtgtgaaaatactatggacagtggaaccaactaacatagcaccaccacagagttggacgaacgtcgaccttgttctatggcatgtaccatcatcattggatcctggtttgtatacgactcttgtggtctgtctttaccttgaacagccacggcaaaatcttcttcttcctcatcacattcagaagatgatgccgaggagcaatgttctaactgaggtaagttgtctttatcaagtgtattttccgttgcactactgctgtaaaaacggcgtagcctctgtaatttaaacgcattgtcgtcgtcttcgttttcgtcctccgactcgctgtcgaactcgtcacttgagtagtaaacaagttcctcatcatctgatttgtcatcgttctcatcgtcattcgaattctttagctgtaactttctctggtattgcgtgtattccacgtctgaagtgtaatcatcgtcgctggaggagctgtaatctgactcatcatcagtgtactcctcatcgctgtcacttagctcggtagttgtaacaacggagtcgtttcccaataacgatatcgttgaatcgcccttgaatgcgacggtatttgtgtctggttggtattcattgcggttctgtagggtgtccatcaaattgtccagcaagttggcctggcacaccaagagacgcaagtttgtttttgggttgacagcctctttggtcaacttgtctttgaccttggaggccagcaaataggtctccgcaaacgtgagattgttttgttgtataataggcattagaatcgcaagacctgtttatttacggataccattctcatggaatacacagtgcttaaatatcatctgcagtattagtaaaacgattacaataacgagtgtctgtttcgggattcggaactggaagcttgccggtattattaaaccagcaggaaatacgcgcgaaagtatttgactcacatatcaattaattgttagcaaacctacggagaaattcttactaaacccaaataaggctcgcttgcctagtattcctcaacgtccagaaatggcgcattgtcctggggtggataattcacgcagtcaatgagcgtatttaatggacttggtgggcaaaccaacgtccgctccaaattgcggatacacatacagccatgcgtaccaacggttctttcttgagcaccgagcaatttgtgataacctggtgcgactgaattccgagcgagctccttttttttttctttggcgctctatgcgccacgatcccaaatcctcttctgtcaaaacctgatttcaaagggcacattgtttagtaatcattaggaagcaatttaggttttttgggtggattagaaatcaacatttttgtggaatttccccattgcaatgagttgctaatttcaagtggtgccagtcgagagctcgggtccctgaaggcttgtatgcttccgttccatagtgcagctacaatgtttattcccctcggctagcaagggaaggggcttgaacaaagggggccggcgttaaaagaaaccgttcgacgtttaagccgtagcacagagcgcgattaaccagcaaatccggtgcgtgtgctatttgaggcaaaaaaaggcaactggatgcgttgtaaaatccgggcctgcagccgtttcctcatccgaacgcttatcatcgcgagcaccaattgttgcctgtaacatccgacatcgtgcatccagtctcagccatcgtctgacatcgtgcatccaacatcgctagtgttctcactttcagatgctacgggcggaaaaccagtatcgtaccgtatgaccgtgcactacctagagatagcttccatttccccagatttaggagtatgcacgaccaatcagttttcatgacagtattctccgaacaacggattgtgacgaaagtttaaagttgaaaacagggtctcaccacagaatcaactgggatcgttcccctatttttctgggactcagcttttgttggttgaaatgtacccgatcttctcaaccgccaattgacactttctccttgcctacagacaatttttcactcctaatccacctatccccccaccgatcccggcacttgtcactctggcttcggctccgcgactgcgctgcacacccactcccccggactactttcagtgacaaacttcacagcaaatttaaaagggccaacttctccagtttttcccttccccatatccaacttctccaaaatgactgacgccgctgccccaaagaagccacagaagaacaccgcagttgatctgctagcaggaggaactgcaggtcttttcgaagccctttgttgtcaccctctggacacgatcaaagtcagaatgcaactgtacagaagaaccagtgccaacgctggcgtcaagcctcctggattcatcaagactggtctgggtattgcagcaaaagaaactccaatggctctttacaaaggtttgggagccgtcgttattggtatcgttccaaagatgggtatcagattctcttcttacgagttttacaagcgtcagcttgcagacaaagaaggaaagaattccacattgaccacatttatttccggtgtaggtgccggtgtcactgaggcttgtctcgttgtgaaccctatggaagttgtgaagatcagactgcaagctcagcatcactccatgtcggacccattggacatccccaagtatcgtaacgctctccacgctggataccttattgttcgtgaagaaggtttcaagaccctttacagaggtgttacattgactgctgctcgtcaagccaccaaccagggtgttaacttcactgtctactcaaagattaaggaacgtttgcaagagtatcaacagctagaagttcttccaagttggcaaacttccctggttggtctgttatctggtgctctgggtccactttccaacgctcctctagataccatcaagactcgtatgcagagagagactggtgtcaccaatgagtctggtgtggcccgtattcttcgtatttccaagagattgatccaagaggaaggtatgcgtgctctgtacaaaggtatcacgccgcgtatcatgcgtgttgctccgggacaagccgtcactttcactgtctacgagttgatgaaggacgtactagttaagttaccaattatcggtaacgaagactcccaggagttggtcattgaataggtaaactagtgaataatagagcatttgaacacattcttcgcattgtagttgtctcatagatatttttcttctcaggcgatttgagatgtcttctcactacagctgtttacctgaaaaatcggttaccccaacttgggttcatagcttactaaatgaactactttcaggactttcttatattttactagattactgtttcttcaattcttcacatgcatcaattaaagtatcatcccttagtcaaatagaccgaatcccatgtcgtcgtcggactcctcgttctcctcttcggcctcctcagcagcagcagcctcggattcaccagcagcagcagcagcaccaccggcagcagcaccaccagtggctggaccagaggcggcaaaagaaaacaataattccttcaaatccttgccttccaaacctttggcgaaaacatcggcccaaacttggtcaacggaggcaccggcagccttagcgatagcggacaagttgtcagcgctaatttcctttccggcatcagccaggatcaaagcagcgtatgaaatgatagcttcagacatattgatggttatagatgaaatgttctagttatggtctagcgattttttttctccaacgaagaaacgcagtcacgagaggtcgaggtcaaattcgcgcactgacgagcatcctgaatgcaacacttactatgttgcaccctggattggttctaccagtatgcactcctgtttggcacctcttgtgtagctgatgtaactcagaataacaccagcatatgccatgaactctaggctccagtctcctttggcatagacctctggaattctttctgctagtggaggaaataactgttcgtataaaggtttgtaaggctctgtctccacgttgatagtagacaacggaaacttggtcttgaggttatgtaaccattcgggtaaaactgcctgatcttctttatcataatactctctattcagtgttcgcatgatccacaacaggatgacagtgtcttgaaaattagaatcctctactttttccagtgaatcaaatcctagtgatagtagtaaggaattagtaaatgtagcatcttttttccaaatactctttagtgaaacaactttagagcgatactctttcagtaagcccttctctatgtgtttgagttcagcaatcatagcaacatagagtttttcttgagtatgtctgtagatacgagcattgttgaagttcctgattgatcttgcaatcaccttctggtccgtagagtcaggaaggggagctgattgaggtaaagatgttttctgtaacacttgtctcttagcctccaaagcattgcgtagctgtgtcaatccctctaatttcattcgcaatgaaatttggtcaacattcgtaacacccaactcagagtcattcttaaccagataacaaaataaattgaatagatctttcggaataaggttagaccagttgcataggaacgtcacgccctccctaaattcttcgtaacgatgatctccctccttaaatttgtattttgtgtcaaatgcaaaagtggtaaactcgtctttagtgtgcaatttgacaccaaattgttccactcttcctagattgtccaatggtagcttgattcgtaaagccacaacgtcagttttggaatcttcaatacagaaaccgtaattgagaagtagttcttcgttacccttgggcccatagttgttgttaatctgggcgccgattggcaagtcagagaagtcgtcgtttgtgaacgagaactttttatgttcacgatctacgtcccaagacactttacgtgctggttcatgattgaataaatccaggagcggcaaaaccatcaccaaaccgtcgacagggttgtttttatttacaaggtcataagggaaacttctggaagtcagtatcacatgagcccaaagataattcgtgaaactagtaaagctcttgtccaattgagtagtcactgtagtcttgtgaagaacagagtcactgactgctccactcttaaaggcatgatatagattgacatcttgaaagtacgaagagggacgatgagattgaggtagctccgacaccacagcaaaccattcatcaatcacactagctagtttcaatttcatagccgcatgtaggttggttcctttcaacagatcctgttcttccagtgtccaataatatggaactccaacctcctcacctgatgggagagattttatgtaaaccttcaaaggactgtcatcttttaaagtgcgttgcttgcaaaggaacaatttcgtcagagaattaggatgtatattctttgactggagatcttcgtatgtgagctgaaattcagagagtgaagtttcaggtaagatggcgagagataagggtaatgtgatggtactctcgctggcgtcagcttgttttattttataagcggcaaaaccatcggtatcagtgtatctgaactccaagcaatctgggaaatgagcccctccggctttagtccactcaatcagatcctctatcctttgatccatggtcaagttatttcaggtaaaaagaaaaagtctgagatgttgcctctatggagcgcgataaaaatagtttattcatacataacataccaattgtttacattgggtttttggttgaagaagtgaaaggttataattgaaagaatcgaaggtcattgacacaaaacaaaggaacaaaaaaataacaatgagattttatttcgttgagaataaagtttagttttccggggagttcttctcgttcatttcttttgaagcttcttcatctttcgtaacttctttttgggaactagcttctttaagttgtagttcaattcggtttcatcagcttcatagattgctggctcaaaatcatgacaagcaacttcctcgtttacgatagactcagcctgctggtcgagtaaatcttggtaggatatcttatacttgctgtttctagtttgatgctccagcaactccacatcggtgatggaagcacccaattccgagtcattgacgaccaatggctctctagtgttgtcaactgaaccctttgcagagcgtcccgaacgaaattggaccttttgtttggggttgagcgctgctgcttcagcataagacagcttccttacctggatgtccacaaaatccaagtcgtccttcatggtaatcaccttgtccagagcgggaccactgctgccaacagccttgcggttcaaactgccatctgtgcttttcgaattggaaaacgaaaacattccaaacagccctcttcgtccgtcattgctctgtggagtcttatctatggcttccggtttggtagtttggtccaggacacctatcttgttgacgtcaatgatcactggggctgaagcattggctgaaaggttctcctgggttcgaaatggcttgaaaagaaacattgcggggcgaattgcggatgtggacgtgtgtcctttttatattggatacacagataaaagagaataacaaaaaacaccttgtggttcagtcccccacgcggtatgcagccgagttgccgcgtttgccaattatcgcccggattacccgattgagattagttaggcatgcataaatctatttacagatctctcacattatgggctttgaactttctacttgctctttcatgactcttaatctgaaatcgatttcctacgatggtgaatgggatatattgggaggcatccttggtgggtactttgagttggaatagggtattttttttgttgattattctcatccctccgatagtctctctccaggagaagctcttcttcgagggttctgcatcgcccaacccgttaacctctcccttccagccatccaatctaggaacaacaactaagaaattatgttgactttcccaagcaactattccgcataatcctaccatgttgaagttattgctctttactactgtcaaaaaagagccaatcagatccatggaagtgatcttggtcatcaaattcaacggatcttctccagtctctcctgccggataaagaacgtctctagcgtattcctcccaaagcgcattcaggccaataaactcttcgaatttgagcactttcttaaactccgggaattgagaaggatcggttcctttgggcagtttgctgattttcctcaatagagtttcttgcgctttctgtgtttccttgataaatagcttgaactcattacgagtcttcgaagcactgtacttattttccttcatgccgtttcttatccttgcagatctggaatcatgtaaaaagttggtagccatctcttgcaaggtcttcctctccaccacggtagcgttatcggtgggcttgagaaccaggtagtttttatagttcccgtccgcagcatatctctgctctagtatttcaatcaccttatcttcctcacctggattgtagcatctcgacagcaaagtgtactcgatgctattcttcctatccattgcacttgctggcaggaataatacagtgcgaaataaatttcctcatttgcttatataattagcggatctttcttatgggacagaactccaggaagaatcgttgtctgaccattgaccttacaaatagtctcctattgaacccagtccagctatccttttcactgcaggtcaacatatcagtttgccttccccgtctactcattacaaattacagtactgattcgcttattatctttactcatcatccatcaaagtacgaattattcatccccgcatgttcaagaggtatttcacaaagagacttgtaaggtctatctcttccagaactggtattgcaaatgatccttttcaaaatgcttcaaaacgttccattcaagaaactttagaaaccgacccaaacttagaagggtttctagcaaatgactcttggtctcaaacccaaaatgccgaacaggaagacgatcccttcgacttctctgacctgccacagttgagaaatataccttcttatttggagaacatagaaccagggcaagtctactcaaaagatcaattaccatcgccgagaaaggaccaaccacctgaatccatagatcctcctaactataacggcatcgagtcgactggccaatctcaatcccagctgcaagaaatgattagagattatattgactatgatctcttccaagagtttcttacattcatgcactatggtgattaccatactcagccaaaacccaccatgtccttgacagattttttgaaatctccaacgccagctgtagtcttctccaaatttaccaaccctcacataaatttggcattggagatgtttatctacgatacaatgccattaccgcatcaaagactgttattctataaaaacaactcttgcatagtaattggtaaaaaccaaaatccatacaaagaggtcaatctaaagtatgctaatactactcaaacgccaattttgagaagatactcaggaggagggacagttgtacacgatcaggggaacttaaacttcagtttcatgtctacgaagaaggattttcataggactgctttcacttccaatatcatttctagggttaacgaacttatcttcaaagaatatcccatgggattcaatgttgatgtggataaaattgagtggaagtccaagtttgtgggattgcccaagttcagactatctaccaatggaaagggtgatattgtgagtgagaaagactcgtacaagatatctggatcagcatttaaattgtcaaagggtaaatcactgcatcatggaacattgttgatgaattctgatttaaaagaattagggaagttattgagggtatctgaagcccgtcagaagtcaatccattttacgggaaccgaatcaattcggtctaaggtcaaaaatttaggaattgatcctgaccttttcatgtttgaatcattgaaagcatttattgaaatgcatggtcacgaatctcatgcaatccagctacctaatgcctttgaaattgatggaaagtactgtcatagtattgtcgttgacgatctggatcagttaccacagcctgtgtggaactattacaacgaactaaaatcgtgggattggaattttggaagaactcccaaatttgaacataccatatcacacgatgattttgcgtgtgttttgcatgtaaataggggaatggttactaatgttgatctcagcattcttgatgaatcttcctcggattccatccaccagatattttcctcattgctggcagcaatagaaaaggaaccaataaagtaccaagggaaaatactttcaaaatacatccaggacagcacaatctctgactggctgaaatgggaagtagactttggtatctcctatgagaatgtcgggtgtaccagtacccctgccaaatgagaaatagagatggggtatatgcggcttaaaaacttaaaagtttcacctgcatagatgatatgttcagattcaagatccgattacacagaaataagaggtccttgtagtgttcgttttttttattaaaagaaggaagcagatgatgattagtgcgtttgtttggtcaagtctaattgttggtctaatttctggcttgttggcccttgaacatcctcagttcaaggaattttctaaccgcacaattattcaacataatgatttacttgaaagaaaccggtcaacaagtagatttgataaaccacctaaattatacggagttgcattgggtggctggcttgttcttgaaccatatatcacccccagtcttttcaatgataccgtggaagaaactgtggacgagtacactctatgtcataaactaggcaagcaaaaagctactgaagtgctaaaaaagcattggtcgacttttattacggaaagtgacattatcaagattaagaacgttggtttgaacagtgtaagaattcccattggctactgggcgtatgatcttcttgaagatgatccttatattcagggtcaagatgaatttttatcccaatgtatagactggtgtgccaaacatggtctgagtgtttggatagatttgcatggtgctcctagttcacaaaacggatttgacaattctgggcgtagaggaagagctggatggcaggatgagcagaggtatattgacaagacattatatgtgctagaaacaattgccaaacggcatggaaataaatccaatgttattggaatcgaaattctaaacgagccttttggcccagttttgaacattgaaaagttaaaacagttctatcaaaaggggataacggtgattaggaatacaggctactccaaagatatagtgatatctgatgcattccaaggaatattttattggaacgattttcagccctcagattcaaatcttattctagatagacaccattacgaagttttctccgatggacagctaagatccagtttcgaaggtcatctgaggggtattgaggcttttggcagggccattgccatagagaagcctacagtagtagttggagaatggtctgcagctattacagattgtgctccctgggtcaatggtgccggaagaccttcaagatatcatggaatggttcttgaagatggaacggttggagattgttctggtgctaccaacattgaacagtgggcagggaaaagacgtgaagaatttttaaagataatcgagacttcattaaaggcctacaatgcagctgacgggtggtttttctggtgttggaaaaccgaatccgctttggaatgggatatggagaagctcttacattatactctttttccctcgggttgggtttaactttcgcgctagaaggaactacttcgattgaagtgaactatcaatcgcccgttgacataagacaggtacgatgaatagtgccacggactcaattactcataaaaagcctataaaaattaaaacggatatttcaaataacaggcgaaaagctttaaaggagttttacaagttgaaggatgccaaacacaaagatacagaagcacaaccgtccgatcaaactgcaacgcacaacacatccgaggaagtgaataacgaaacattgtcaccggatacaaccactgaaaatgagcaagtacctgcattagacgaaaaccttacggaagaaacctttgatacttttttaaaaactgccgacattggacagttagtaaatcagtataatgtgatatccgaggatctcaacaatactaaagctgaagtcaagagtataatatataacaactactatgaactgataaaaatcaatgacgttctggagaatgttcgcaaattggaaactgttacgacagacactgactccttagactcaaagcaagaaagcacacttatcatagactctttgaactctatcagaagcaacatccaattactaaaggaccgttacaaaggattctcaatcacgatagacgagaacgagaagaagaaatctgagacagcacatgacaaccttacgcggctgatctctggagataaattgactgatgatgatattcacaaaattgacgaggtccttcccaaaatcaacaaagaggctcttttattacagctcaacgaaatcaaagacaaagcgggagcgccagaaacttaaatagaaatagatatatacagctatagagaaatgagtcattacgaaggaacttctggtagggaaagagaatgcgagccactcgtatgaacaatgactagcaatgaggcctacgggtactgtgagctgctctcctatccacagtaggttacttgcatccttcctaaatcaaaaatgacaattttcccagtctcatttggccccataatccataggatgtggacagctcgtttatcttcccgccagacagatatctcgtatctccctaatttgatgtcataatgccatcttagtatggcgcgcatccgcccacggtagcagaacaaatccctcgataagataaacttaaccttttaactttcaagaagcataggtactcaccccttcgtggatttaagcatttttttggtctagaatacacgttgcggcagtctctttcgtagtttcctgccaaatcctctgactccgtcggtaatgcccaagccaatcaattcaccattatttccagtgcaaagtctttcaagggacactgtgataaagttacctcccaagccaaatgctgaaagtgcttctgtgaagttatacatggttttggccgaaaagaacatctttgttcaaggcttcaccgaagaggaattcgcaaacaaacccgcttccatgctaagaggatccttgtttttgcgaatctctaaacctgtcaaaattaaaaccattagccttaaattcaatggaaaatccagaacagaatggccagagggaatacctccaaagaagctagacttttttgaaaaggtggaaataacccagcatcagtggttattctacagctattcccagtcattccctgctagtgaggattctatcaacggagctgacctctacaagaaaccaaatgactcaattgatcatatcacctcattaagtttggatgatgattcatcctctattcgtcagtctcccaaagggatgaccgaccgattgaaacgagctgcgtctccgtccggtattaagaggccttcctccccatccccaatgtctagacaaggatccggtttcctgaaacatttgaacgattccactacagatttaagagccttcaagtccttagacgagtcatcattacaagactcacatgggaaatttccagcaggggattacatctacaattttgagcttcctatacctgcatgtcttccggagactataaatgaaacttttggtaaagttacctacactttaacggctgccgttgaacgtctaggaactttcaagacaaatctccatgccgaaatacctgtgaatattgttagaacaatatgcgaggaaagcgttgaagaaaatgaacccatagtagtcaataaaacgtgggaggacgagcttgcgtacgaagtggtgatcggttccaagatgattcctcttaacacctatatgccgatatcttttagactcgttccaatgacaaaaattcaactgcaccggcttagagttttcgccacagagaacatggaatactactgccatagcaagaaagtccaccgtatggaacctaccaagaaatatctactgatggaatataaagcacccaatggccaaaccaatcttttggaggatgcaaacggaatgattggcatgaaagaatttgaatttgaggtttatgtaccgaagaaaattggggaacacaacacacttcatcctgacacgtcgtaccaaaatattagaagtaaccattggttgaaagtttgccttcgtgtctcaagaagcgatcctcaaccggacaacccagataagagaaaacattttgagatttccatcgattctccggttcaatttctatcagaattggctgtccatgccaacacgttgttgcctgcttatacagaaagtctgatgtcaaccgcttcccctcatgtcccccacaatatgtctatatcacctcctttatcaccagaggtaattgcaattgattcacaggttggaacaatactatttccgggtattcggtacaagacagttcaccagcatctcgagaataacttgtataagcctgatgcttccgccaatcctgatgttttaagttctcctcaagctcaaccatattcacccgagcattcacctgttctttctcctgtgcggtcagccccatgtccgacccggcccacatcgaccaagaaccccccctcgtttgagagcgtcatggaaaatacatcatacgaggcggaattacctcctagctatgatagcctggttgataaggatcatcgtcactcgatttcaagagttttggaggaagtggatatgggtgttagtttcaagttccaagggctgtcccccaatcttccagactcaattatgagagcagtatctcctgccagaggctcaaattctgctcagaattctaggtctgcgtctaggcctgtatctacatcaacatccagaccggcatccagaccggcatcgagaccgccttctagaacaaactcaagatctgctagtcgtgtgcgtggaggcattgccactcctaatagccatttatcaaccagttctctttctactttgaatgctgctttgactgaggagaggggaagaagaaaccgaagaccatcgctgaagccctcaaaaagtaacagcctcattgataacaacctggactcactcctcctcaaggggaataatatcccgaaagaagacactcctgaggaagaaattgccactatgcccgctactgctcctcagcctccatttgacgatccaagaagggaatcctacacagcttctctggtttccgtctcagagttttctggtaaagaaaatgactctgcagatgcagttgtcaaagattttagtatgtacagaccaagaactgggtcctcttcaactataggcgatgacaaaaatgggtcaaccacttcgtccccaattaatagcccttctatatatcagtcagccactacccaagcggcagacccagtttcgtctcttccattacttcataactcttctgcagccaatgtttcagaaagcactatcattccatccgaaccatttttgaaatcagaagataatcttcacaacgctttgtcaaactcgctccagtcatttgataccagcactcttctaaaccccaaagaggagggtttctggcatagctatgccaatgaagataccccatcttggtcgaataatttaccgggtactgtccaaagtggatcaaattccttgtacaatagaaaggcgagtaccggagtggctcccagaattcactctggttttgaaaaagccagtgcagacgatgccaactcttttggatccgaaaatagtgatgaaacgacaaaacaataaagctttaaatggaatctagcattctatcaaaaccgctcttgtcgtacttgatgactttgcttcctccgtgcttcaagaactggggcacattatatttatcatagaatctgtaatataatggggccatagcaacaatagaagaaagtagcttcttcttcaatgtaggatcagtgatgttgtaatttttgtaccgttgaacaatcttttcaaattcctggttgaatgtcttaaatctttcttttatagcgtctctgccttttgaagtggacaaattatcttgcatttgcgtacctgtaataatcgtctgatcaattaaaggctgagtaacggtcatccagtcgttagtcacaattatactgttcttcttttccagtttctgcaatcttgtttcgccatacgaccctaaaatcctctctatattggatctatggatgaactcttctaagaaatagaagttactgtataccagtacaccgagaccgttgtacttcaattccttaccctttatgtgaagattaatgatagcacactctatgcagtgacaaacaaactttgcaagattcagcttgctatccttcgagggttccaaattttctttcaaatagatattgtcctttctccattctggagtattggcagtattcaagggaagccagttcttagggcctatatcttgcattacaagccagcacgactctttgttgtcattgatacgtttcagtttattagtgagttcagatattggtcttacaatagttgttggatctgttggcaatgatgaaaggtgcaaatatccattatcgatgtctcgcagaatgttagaaaaaactttaatcggttggtttttaattaagttgagcatttgttctgcttgacttgaaatgcatgagtctaaatcgtaatcgtggcaatattttcgaacattctggcatgattcaatgacttcgaaggacagaaagccgtgcgtgtccaaatgggtttcgataaaatccgtcagttcctttatcagcctaataaagttgtcaatcaacttttcaaaaactgcaactaaggtatcactaatcaattggcttttgttcctgctggattcaaacagctcttcatagaatgcattttcattcgtaataaacgaaataaatgcctcagaatagttactaacaccattggaatttttttcgtacgttttggaattcagagtaggtttcacgaacatttccaacctctccatcgattcgtagaccaacctaaacctctgttccacgaccactcttactaactttgcgtcttgatttctcctttcaaaatatgcaaaaatcaggcgtagaatgcctacggtttcttcttcaaaaaaggggaatgcttcacgtttagtcataaacatttgcggatcaaatggtttggagttttcaatcaacaaattacggaacgtcgttattaggtgtagttctgcatcatttattgatcttatcaaactggaattcactcctttaaatatccctccttcttgggattggtcttgattgtttaaagtgcttcttgcttgatcaatcgatgaaatgtatttcttgcaatcgttagcgttgtcaatagacccaatcctatttagagttgtctgatattgagatgcctctttagcatagtctttaacatctcgtagaatcagcatcatgttatcaatattgtcattatagattttgagtgcatcaatatcactgattaaaggtttcaactttttggcgctcaaggtgctcttgtacgatatatcattcaatttcttactaatagcaaccgaaatggtattcgtcttgttcagactatcatcaagaacagttgattcagcttcatccaaatcaattgggattcgttgcatagtccactgtgggtggaaggaaatgttgttgatttacgtgcgacaattgccagtagggataggagacctcaggaggacccgcgagctttcaaagtgtttggagaccgatacatccaaatcagcgtccccttcactgcgtttcatggcccatcaattaggaatcccttccggaaaggtaatttcgaatgagcaggtagagttagtaatacggaacgatgaccagagccaagttactgatacattggaattgataatattacataatctttcaaaactatccacaacttttacatgtattgaaatgtccaagattccactcatattggaattgaatgcattaccccatatcagcgagttactacttaaataccaggttgataacgtggaaaagttgatggaaaagtttttgattaaagccattattaacaaaaagatcaagggctctattgatcaaattgcaggagtagtcaatttcgaacatgaaaaagtggaagctaaaattgactgggagttgaaggttagtgatgtgttgaatgaattagataatttaagggcacatttagaggccaagtgatgcagggtgggcgagtttatcaaaagtccccggattgaaggccatccacaattgcattgaattcatttttcagcctcttgatctcctcttcggtgtcttttatatattcttgtttctttagcaggacgtgtgaattgatcttgtacatttgagatatatcgacaggggatttaattatatcatggtacctttttagtatttttttaatctcaacattagcactttcattcccgtaatcgttctttagtatcggctcttcaatgtcagagtctatatctatttcgtacagggtgtcttgcacctcgtttttgtaagcttcaaaatcttgttcactatccctttcgattgtaggcgatgttgctcccgcgtcgaaggaaacaaaatcctcactctgtttagaattactaattgcttccagagttctattggttatttcaggtggttttggaatgtccagagttttatagtatgattcaagtcggtctttctgtgatagtggatactttggctggttgtcatcgtcctcaatgtcctcgtcaggtattgagaggtttacttttaacttctttctaatggggggtttcgggggtttgtaatcccttacttcttttgggggctctccatcctctacgatcacccttataggccgtcttctccttggtatcattggctttctggtgatgagaaaggatgagatgggagagatcgcggaaagctgagagggacgggaatagcccaaacatcagactatttaacaaagccgctgaagacacgtattagcaaagaggttccactccaactctttggatctgtgttcccgtcatctattctttctccgtatcttcatatttagattagaaggcaatattgcgagatgagcaagtagatgctggatggctaatagccatgcatcgagaaaatcgtgctaaaaaaaaaaatctccagaacctaaataaatcagacattccatccctctattcctattcctcacagaatgagcggactcagcaatgctgccaaggaaatacacaatttgctgattgctaatcagggatcatctttggcccaggaagaaatccttgaacatttcaaaggaaaggatctgggcgaagataagatcgaatctgtagctgatctgatgaaacacatccaagaacttcttaaccgccaactcatcaatttgagccaacagggaactaccctaaaattcagtggagtagatttgaaacaggctagtaagatctcaaatatgtctcaagatgaagccatgatttactcctatatcgaaggttcagggagggaaggaatctggacgaagacaatcaaagccaaaacaaatttacatcaacacatagtactaagatgcttgaaatcattagaaaatcagagctttattaagtccgtaaagtctgtgaagcatcccaccagaaaaatctatatgttataccatcttaccccatctattgaagtcacaggcggaccttggttcactgatagtgagctagacacagaattcatagacagtttgttgattataatatggcggtttattgctaataagacgtatcctaatttatttggtactgagggcaataaagctcagttgtatgaatttagtgttggtttgaataatgcacccgatgtagctcagattaacaaatttatccgtggatccggtattacgaacattgaactcacagacgatgatgttaggtcactttgtgatgtattatgctacgaagaaaagatagaaaagttggaaaagtttggtaaagtggatagttacaaagtgacatggcacagcgttgaagaagcagtgaagttggatgaaccagagggagatgttgcccctatattcaccttttatgacaaccacaaagttgttaacgctatcgacattgaaaacccagatcagaactactatttggatgcatatttgaatcagtaattaggtctatgatgattatatagtatacaatggcgggggttcttttgtggtgtacattaaaaagttgtgcaatacctgatcttttccgaaattcaactgaagagaatcaagatcagatgatatctgttgatcttcttcctcagaagacagggaaatgctatcgctgtctaatgatgggacaatcgattccgcgcaagaaggattctcataatttggtggagggagacaacctaatagggatagctcgtctagtaatataacagggcaatttaaagcaacttctatcttgttagaagctttgcaagtattatttatgagattgggcagttcttggagtattatgctgattttaagcgtgtgcgagatggtcattgtgggtgtggttatgcatggagttagctgggatctaaaattgtgcagagagagctccaattcaagttctgaaaaggactccgatgaagcttctaatagacatctgttggcagtgtggccctcagggaccgttaccctctgaattaaccagcatttgtatcctaatattctgaaaggcggaggataaacatcaggatgtaagttctttaaggaaacacttacattaaatgaatcgtcagcagaagtagttaataattttttactcagagagacttcataattcagcagagaccgccagcaaccctccactaaagctgtttcacttgccaagttggaattatccaaaggacatctgatggcctttatttcccttatagggggatgaaattgagtaattgcgcaaccgccatcagagctacaggaaaagtaatccacagctgcctctacgtagtaaaacatagagcctactctgttaagcttgaacgattctaccagctcattggagagaataaactgaaatggatacacttcttttgtgtcagatattggagcatatactttccatgaatatgtttgtttgactaagattttctttgatgtttctgatttgtatccgcaagcggcgggtatatttttgatagaggtttcaactcctttgaggtctatgctgatcgttttaataaaagggatgacatctggattcatgcagtttcggctcaactgcaatgatcccctcacgacaggaatggtattactagttatactctcatggttattgagtcctttgaaataaacaacgttgtctaataacttgatgtctcccgacaaggtattatccgttggatcagaagaccgtgaaacggatctggatcttgacaagtacttcgtaaagctacaagttctcattctcttagtaaagaaaagaccacaatagcagaatacagtaaatttgggaaaaggtttggccaacttatttgataaagaactttcgaacaagtggagccatagccgttatgttatattcgatttatctttgtgtcatcagacgtggaaggtgagccgcacacatgtctggcctctgtctgcttatcaatacgccgttcgctcgatgacaatttccaattggtctagaacgggattattaagaccggaggaaaaagccacgctaggggggcctggcccgttctagggtatattggagagactccaacggtctaggatagagtatcacattattatcagctagaactctggtaacttgcctaggtgttcggccagtctagaattttgtcggttcccacccccaccagttttccttctacccatctacccacccatccaccttactctctcccgtatcgcgagacttttttcaggctataagtatgctacccccacacttttgaaggaagaaggctattcaaagtgagtaatcaacgtttgatggttcctaatcatgtggggggagtggggatagtggagaaaatagatcaaatcttgttgcctttgttgcacatcggttcgatagcaaaatcatgaatcaacccatgaggctggatgtcggatgaagggcacgagaaaacttcgtctttgtaagccgttcgcaaagcttataacttccatctggcatcgcggacgcggattctaacaaaaacattggtgtaaacgcgaccagtctgggatgactcctttcttctagtaaacaacccttccgttcaacctctgtcaagagtataaataactagtggtccccatatcgcaagccctcaggagtataacaggatatgagcaggcaagttttgaaacttcaaaaccccaatagtaggtcacgatcaagatcaagatcaaactctcccaccaagctttttggatcagtaactccttccggaacaaggtcaaggtcaaatactccatctctttcagcatctccgacaaaagagatacttatgccctcaagcacacttcaacaaactgatcccagtgagttgctcaagagcagtcgtaacgaaattcgtaaaagatctccttcattcacaatctatcaggatgattgctactatagagacactcttcaatatacccagcagaatgagttagcatcagtagatgatagtgataaagaaaacgcgggaacaacgcaaaagaaagaaataacccagcctgcggtattatcttcccagagatctccattgagtgacctgtcgatttaccaatttcctgggttcatgaatctgcataacgctgatgataagtcatcaattagcgtcttgaggcctaagacgcccttaaccaccacatggatgatttctacggaaaacaaatccaaaaaactttacattccatccttcataactccaccaaagaggaaccgtgttatcaagtatgtatccagtttaaacaacaagcaaaaaggtccaaaacgattggattttacagacgattgtcgagacttgaacacattgcttcccaagcccatctctttgcattatgacaacttttagcattcacaagaaaaaaacagatgactattctccttcttggccaatttattctggttggtctcgcatatttacgcttttatacgattgaaaactccataaatatcccattctaccgtactgttgagttttgagatcgttgaactctttacgacacagctgctcttactaagctactaagctatcactctaccagtctctttatcggctttattttcaggcgcgcctacctattgccgtctgtcctaagtaatatcggcctgctctccggcccatcccctattcaactcttactcctctcttcctttccttagaaagaaaggtacttagttatggacttgtcttcaaggctgtcctccctcagaaacattgactcaagttctgacacactccccagttacagcaaccccaatgaccgaaacatcatcaagtccctgctggtcaaaggaaagagtttgatcggtaaagagaaacacagaacttttgacctgccccaatccaacaaagaacactttccttcacatccgattgacaagaagaccatacccccagaatttatatctccgggagttcccctagtcagagtgacacacaagaaaaaagttaataaatcattcagaatagattttgataatggactacttgtttgggatagcaaagcttcttcgtccataaagatcagcaagattaaacagataagacaacagcaccaagcttggaactatattgaagagctacaagttcctcgatcattaactaaattctggatttcaatcatttacattcctgcaaagaaacacaagcataataatatcaagacacttcatttgattgccggctcagaagaatcgtattcactggtggttgaaactctgacgaatatggtagcttttaacgacacattgaggaaaactcaggacctcatgatggtggcagactactgttggaataacattagctccaatggagtggtcacacttgagggaatctcgggattgatcaatcattatgacatgtgtacagagtcagactatatcaaatctttgttcgataccgtcaaccccaccgattgtgctttgacctttgaccaattcaaaactttcattagcctgctccaagagagaaaagaggtcacccaactattttattatctgacctctcacgagagcaaccaaaatcaaaataatattactttaccaacattcacgatctttttgagggatatacaggaggaaacaatgtccgataaagagattttaacttgcttcacctctcttgcaattgcaaacgctcaaatacctttgagcgagttcacaaagttttttctttctgactacttacaacccatcaagaacattcaaagtgaagaagacctcacacgtcctcttaatgaatatttcatatcctcatctcacaatacctatttgctgggaagacaaattgtaggtatatcttctgtggaaggctatgtgaaagccctacaaaaaggctgcaggtgcattgaaattgacatatgggatgggagtattaccaccaatttggaggagatttctcctcctttgcatgatgagacgaacgattctatgagaccagtggtgaaacatggtagatccttcacaagtgccgttgatctcaaacaggtattgaaaaccatcaaaaaaaatgcatttattagatcatctttacctttaatcctctccttggaaattcattgcaacctagagaaccaattgacagtaaagaggctaattttagaaacttttgggactgcattagtaaaggaacctatcatgggaaacgaatcatttttaccgagcccgctagagctcatgcatcgggttttaattaaagtgaaaaagactaaaacagtgagcaagtccggagctgcaaacaataccagtaccagtttaagtagtagttttggaacaagcgtatccggattgagtgaagatgaaacaaagaattctagcaagctccctattaagaagatttccaaagaaaagattcaccctgagttaagttttcttggaatttatttgtcgggaataaagttcagaaacttttctttacctgaatccaaatcattcaaccacgttttttcctttagtgagtccaaactgaaaaggtttatgaaggaagaaaccaaaataattgcccttttgaaacataataaacgatatctaatgagagcatatcctgctagattccgttattcgtcaaccaacttcaatccgttgccattttgggagataggagtaccaatggttgctacaaactggcagacgtttgatttagggcagcaactcaacgaggctttatttgatcaaccatttaacagccccttgcaggggtatgtgctgaagccctcaaacctcagaaatatcaccattacatctaacaagaaggttgatttgctgaaaaatcaagcctattgcaagttgatcaatgttaatgttcaagttattacggccagacaactttctcttagcaatttcaagaagcaaccaatcaacccgttcgttgaatttgaaattcatggatgtaatctgtcttgcaaagatcaaggcaaaatcttgagaacaaaaacggttcaaaacaatggtttcaatccctcttgggacgagaacttcaacgtgtccttcaaaacaaatcagaacaatttgaatttcattaggctcttagtgaaaaatgacaccggtagttcaacttatgatggcaatgacgataacgaaaataataacaacaacaacaacgatagtaacgacaattcggagttaatatcttcctggtgtgcaagattggcttatgtgaaaaatggctacagatatctacgtttagtggatgcgcaaggcgaagagagtctgtgtgctactttatttgtcaaatttgatattactgaagagagaataattaccgattaatgtatatagcttacttagttactgattgtgtcttattctacaattccattctctcatctgtgttctccgtccttggcacaccagccaacagttcccttctgatttcaggacctatatctctgtgtcctctggttctaattgtctctaataagaaatcacgctgatcgtcagtgatatcattcttgtagtgttgggcgaaagcaaggaacgccttatgccacactagtggcattggaggtatctcagagggtttatttgctggatcatagtagttcttcacactgtctgcaacttgtccattgataactctgaatctcataaagtagaagaccaagttgtcaacagtttgatagggcaatgcatatttcttctctagtaaaattctgataaaaactgtcgtagctggttggaaatcttgttccgttaaccaagaaagagcagcagccgaatgcaatgctggaatggaaacttttgccagaatggagcctgcaatgattgcctctctgacgctacatctttcctctaccaatggaaaaagaaatcctttgaaaaaggcagctggtttatagagtgatttttttagagacctgtacaaatggtagtttaacttgtggtcgtcggagtcctctatgctggctctgaatctctctaatagaaccatatggacaaattttgtagcatctttggaaccaaaattggatacaaacagtttggtggcttcgaaacacacgttgggggtccacgcatctggatttgttacataaaggacatcttcccaacgttttagcgtgggaataactttgaatagttttggaagcctaccatgcgtccaagtggtcaaaagagttcctatagtttgatatgcttgaatgacctttggagggagcaatactgcatctaccggcttttcatttttcctctctgcttctgcttgtaattgctcaatcttagccatcaccttatcggctagattgaaacttccttcaggaaaagactgttcagacttgaaataagactgaaatagtttggcatcttcttcattaacgtattcttcttcaccctcaaattcgccatcatactcttcaccatcagacccttcaaaggccttcatttcatcgtactcttccgtaaaatcgtcctcatcttcatcttgttgttgacgaacttgaaacttcacgaatggatcatccacccttttgccaaaccgattttcctctgactctatttcttcttgttgatctttggctaattgtaaaatctttctagttgccttggagtcaatgatggtatcttgatcctctccatccttctgctctgaagtagaatctcttccagaattctgggaagcagtcttgaacctaccagctccatggactatatccttgtaaagtggtttatggtgctcctttaccttggtttcactggttgttagtttacccatatctgaactaaaggatgcaataaaaagaaattcaaaccataaagaaaaattattagtacaatgaagtgaaaatttctgttgccgcgattccgcctagaaaggttacgttacaaggactttgccatagttccttctggcggacacttctgaggcccgttttctggttctatacactacctttttaatgtcaaccttcccgatctcatcacgttgtgatctgacataaacaaactgtgaacccataacaagaaaaatggctcgtttagtaaggaagagaggagaaaccgagcccaatgggccttctgtgaagagagcaaagtctgctgcatcaaccttagcttcaagacgggcttctagactaccttccatcaacgaattccccaaagctaagactgaaaagttagatctattcgtttttggtacaggctcgatgtctgaactggggttaggcccagcagcaagcacaaaagaggtcaagcgacccagattgaatccacttttgaagaaagacgaagtcggaattgttgactttgcagtaggtggaatgcacactctagctttagattataagaaccaggtctggtcctggggaggaaacgacagcggagtactgggaagggacaccagccaagcacaggaacaactaagagacatggacgatgaagacgatgatgatgaagatggtgatttgaacgaattagaatccactccaggcttggttgaaggattgccagacaatcagattgttcaattgattgccactgataacctgagcggtgttctattggaaaatggtgaagtatgggcctggggtacgtttagatgtaatgaaggattactgggatttttagacagtgaaggaatacagaaaactccaagacacattccaggatttgttaatatcgtccaagtagcttcgggaaaggatcacatcattgggttggacaacaaaggtattccttatgcttggggaaacggccagcaatttcaattagggcgccgaatcctagaaagaactagattgcaatcattggagccaagagagttcgggctacggaagatcaagtttgtaggatccggagaatttcactcttttgctatttccgaaaatggcaaagtttacgcctggggattgaaccaatttggacaatgtggcgttccaattaacattgaagatggtgctgtcatagcaaaaccaactgaaattgaagaattgactggaaaggatgttgtctatattactggaggtgagcatcactctttagcattaacaaaatcaggagaggtttatgtttttggcagatatgatatgaaagagattggtatcaaaaaagacaatcttcctgaggatgcttacaaagatgccaacggaaacactcgtgcagttcctgttccaacaaagttgaccacccttcctaagataaaggcagtaactgctggttctcatcattctcttgcaatcacagaatcaggagtggtctactcgtgggggtttgctgatacttatgctgttggtttaggtcccgttgatgaagatgtggaaacaccaaccagaattgagaatacagcaacaaaggaacatgacatcaaaatcattggtgcaggtggacaattcagtgtcagtggtggagtcaagttgacatctgaagaagaaattgagaaaagacttgacgagattgaaaaatttgaagactccctttaaaaagtttattgaaaagttcataagagtttgattgtataatgaatgaaatttattaatctatttgtcagttctaactaagagacctctcttggttaaaaaatctttaacttccttgacagtgtattctcctctgtgaaacattcctgctcccaaagcagcgtcagtctcggttttcctgaacacttcctcaaagtgggatggatttcctgctccagaagacgctatcactggtaatttagtggcagacttgatgtaatctattaattccaaatcataaccagagttggagccgtctttgtcaatgcagttgcaaagaatttctcctgcacccagcttttcacaagcatagcagagttcccaagctcccaaatcgtgaacatttcttccaccttgactagtgaccttgtaataacaatagttctctccgttaggtccaggaaatttggtttttatcgtcttgtatggtgtcttggagggatcagcgacataaaatctttttgggtccacagaaatgacaacagcttgaacaccatatgaagcagagatagtttcaatcggtgtcaagccggttcccttctcgttgttcctataaaattcctctgcagccaacacggcatcagttccaatagaaactttatcagcaccagctctgaaatacaatgtggcgactttcaatgctggaaccttggttccatcgggatcaacgacatctttaatcccaccaccgactgtaagaggaacaaacacagtttcagctgcccttttgagaacttccagcataggagcgtccttgatgggagagtttctgaacgaagttatattcaagaaggtcacttcatcggcgccttgttgataatatttttcagccatttccactggctttcctaaattacgaacatctccgctttcacttttctctctcacatcgtactggtcacctttggtaacgaccaaatcaccagagtcattggtacgaacatcaagacatgcaataattcttcttgtcagtcctgtaggtgttacttcaatagaatcatccacttgcaagtctgcagcactcaaaggggaaaatttctctcctctaagaaaactattaataactgcaagaccggcagctccagatttctcgggatgaaattgagtagcaaatagattatccttagcaatggccgatacaaactcttctgtaccatatctggaggtggacaaagtccaaccatcagcctctagggactgtttttcaggctcgctaagtatggcagcataggagtggacgaagtagtatttggagtgaggacttataccataaagtgtcttgccactgtctaaaatctttctatcaatttggacactgttccaaccaatgtgtggaacgcttttaccacccaaatcatttggattgaacttagtcagttgtaaaggaatatatcccaaaccttctgtatcaggagattcactggaaccagtaaaaaatgcttgcaaacccacacatattcccatcaaaggccttccagaatctatataccttttcaaaggttctagaaatccttttgctaaaaactggttaagaaagtgtccatagtttccaaccccaggaagaaacaatttcgtcgctgtcttcaagttttcatcagcagcgtctcggataaactccacctcgtaaccaagatactctatagcattttgcagagatctaaggttaccgctttcgacgtcaatgacgaaaactacttctttagacatgacgatgagtgaaaaggctactccaataatagagattcctcatctggcaaatttacagatgttagtcatcgtgttcgcgtttaaatgagtacgacacgcataacctcttcttatcgtgaccgtaccagcccatctgttattatttttgttatcttgcggttggacttttacctctttactcttttaccaattttagaatcacaacaggcaactcgtctccaagtacaaaagcaatcaattcccaatcctatttcccattctgaaaaaagtaagtaaattcaattgttgcaaaacgtgatagtctccttccttcggtggcaaccctcttactaaccccgtctagatgcgatcgcaatttaaagacgaacacccttttgaaaagcgaaaggcggaggcaatgcggatccggtacaagtttgcggaccgtatccccgtgatctgtgagaaagtggagaagtctgacattccagaggtagataagcggaagtacctggttccatgcgacctaactgtgggccagtttgtgtacgttatccgaaagagaattaagatcccatctgagaaagcaatttttatattcattgacgacatattaccaccaacagccgctttgatgtccaaggtctacgaagaacataaagatgaggacgggtttttgtacgttctttacagcggagaaaacacgtttggagatattccaggtgttgaggagattgaataaagaaaagaccaaaaaagagaaaaatcgatcttcttaaagttagctggctggctttgttactgttttttgatggtgtttaacgttctagttattatttaataatgtgtattttctcctttaaacgagattcaaacactttgctctttattctaccagcactcgttctcatgcattgtccaaggaggtaattgatcgaaccaggcttgtttccttcctgtaactcctttacaatggctgggtacgtgtcaagcacgtcgtcaatgatggaatctacttgagccagtagctcggagtcgttggtgacatctacctctcccaattcatatttcgtaatgagatcaattattggaccctcattctcagcaggattagcaaggagatgctcaaatagaattttagcattgttgttggtgacttgttctcggaagatacaatcgattaggtcagctagttgatgaacagggaacagatcttcagaaaaatctatgttgttctttgctaaatatcccaaaaactcatgacagcaccaattgattgggtatttggatggaatgttcttcgccgacgttctactaaacagagcatagtaatagcccagaagatttctgtcgttcaaaagaattctggcatctctcaacttgatattgtaaggaggcgacattagttgcgccaactgctcttctggggtagtaatcgtcatttttttgatcctggtgacaatatcgttaacatcaagtaccactggtggaagttcggggtctggcatgtatctgtaatctacactagactccttatctctgagtctgaaagttttattcccatcccagcctctagtttcttttgttttaataggatttcccttatcaattgatttggtttgacgtttgaattcgtatcgaatagcattgacaattgcagaagtggacgtcatattcttgatctcaactctttcgccatcatcaacagacacattgacgtcaactctcatcgctcctgcttccaattgtcccgttgagacatccatggtcttcatcagctgaagatatttcctgagaaatgccttgacttgtttcacggaattcagatcaggttcagtaaccacctctatcaagggcatattacttctgttgtagtcaaccaacgatttatctgaaagatccttatacaacgatttccctgtgtcctgctcaatttgaatatgatgtatacgtacgagtttctcatcttcgtctatctcatcaaatcgcttggatagcttgagaaatcccccactgctgattggtctataatactgagtgatttgatacccattcggctgatctggatagaagtaatgtttcctatcgaatgtagagactgaatttatgtttgagtttagactcacacacgcttttaatgcggtgagaagacatgcctggttcaaagtaggttgactaccaggaaggccaatatcgaaaaaagagatgttggtattcggtttggacgcctctgtggaagacaatgagaagagtttttgccccgtttttaactgggtgtgaatctctagaccacagaccagctttcttaacataaagagtgaacaaaagatttgtagattcaatgatcgttcttgatggggagatatttcagaattgcgcttacataagccgactagagtttgtttgtaataacgaagttctagagacattaatgcgcaagacagtgtaatcatcattgcatagattcagtatagccatgtatatcatggttgtgtgcttgatagcttttcaataatcggttcaacgtcgatgtgatttcggctctcatttcaatattcattacgtaagctaaagtgccctatctttttctagttcgacaatactcctaagtctacaacctcatgttcaatgttttactcgacttacctaaaactttctccgtaggtatcgatgggaatttcttgtctagtgaaaactcacccttccaattgaaaggaatcaaacttgtcgaaccaggagtccactttatccacctggaagacctcaacctcaatcttagaagtggcatttggatcaacgggaaagacgaccacacattagtgattgatataaaagatggaatcagtgatctctcagtatttattgtgaaccatatgactagagaaatgatcgtgaaaccgtctacggaccctgtagatgttgattactcaatcgaagttggaaagattttagacactatgagtgaaaatttcccgttaatggtcaactattcatccttgaataccaaacatccacactgggagtcacttaccaagtatatttcatttcctaggattttggacgtattgcaaggtaatcattggtttactcttcccatctccactctagatgcgtcaaagcaagagaatgagtatcttatagacaaactgagcaaaacttctatggaaaagaaccccgataggattatacaatctctgaggaaagacgactatcaaatgatattttcaaccattgagttcaacaaaactgctagaccgaatgctacaccctctcagttgactcaagattcagtggataaatcttggtttgttgagactaaactgcttcccggcttactacttgagtttcagctaagctttttactgttcatgatactcaataatgctagcgctgcttctcattgggttaatattatcaaaattatgctaaattgtgattctttggttgagatcaatgaaaatctatttattgaattttttgattgtttgagtattcaactaaagataatcccagaggaactggtagcttcttcggattcaatggtgaatttacaggctttgaaagaaagcctaaccacgtttaatgaaacgatagagaacccaaaagtaagacgatctttcaacagggtcaaagatacgctcaagctccaatttcagtttgaagatatagattttctggatgatatttgatcaaactcatttttcgggataaactccacctgaatacgattcttccaatatgtgtcgatcattcctaacgaaggaagtcctaatatttttcccgtcacagatagatcatctaataacagaacaggaatgttggttagtatcttgttgggtaagcagttccctggctgactttccataaacatattatatgctgttgaatgcagtttaggcacatatggtacgattttgatagtggcatgcccaaagattggaaattcatctgttgttttaattcgaatccagcaacggttgtcaaaaaaaacccattcagaccattcgttattatggcctagggcaagctctatcatgggcaacggctgattagcatggtattttgcagccgatatactcacattgacgcagtctgagcccaaatctttgtagcttgaaatttcccagttcaatttaagcaaggaaaacttttccgggtggcctttaccgaagaccactctttttagaatagagtaaatacttctggttgatttggacttcacccaagcgctttccacatctaggtttgtgaacttgtaatggtaacttttcaggggggatatcttgtagcattcttcataaaaaaatctgtttataactaacggatgatatctcttcagtatctgtccagataacaataaactaagcctaaaggttgctggatcataccagatttgccctagtcgattcaattcatgtcgtaattcttccagactggaatatatagactgttgaaacgactcaatttctgatataacttgtaaaatatgttgctgtgttagtgttttgggaatgataatatcccctttttgatatacactgcgcatcagattgcgaaatgttaatgaagaatcggtatttgtatgatcttcaaaccaaggaacttccagttctctgcaatatgagtagatatctttttttctaatgttcagcattggccttacaatctttatgggaggttttaccgacgatgggtacaaaggaagggaaggataagaggagatatctttcatgcatctcatgccaaatattgtactattttgcttcaatctcaacaagaaggtttcgacttgatcttctagttgatgacccaaaaatagatgctgaatatcatagtcataacaatatttctgaatatgctgatatcgtttcgttcgggctagtctttcaaaatttcctaactggtgcaattcgacagagtccaagttccattttagatctataattttatgctgtacattcagaggagctaccagttttccaacctcctcggcttcttgccgactaccttttctgtattcatggtttactgtcaaagctactatttcaaccccgacgttgtactcatctctgtacctactcaacaaacttgtcagtgccatagaatcaaccccaccggacagggatattccaacacgtcggggcagtccatgagggaatattttgacaatattgtcactaaatacgtcaaatacttttctgttcatcctcttcccccttctaagacgggcgtaggataacagtagcccttccaatagaaggaaatcaatgcattaggcatttacgtcgtccgcgaagttttccatattaatccgctggtgacgttcttcccttaggctcaaatttttttgactcattctatcattgaaagagtaaagagtaatgtcagaacaggacactagattctccttccccaaggaagaagaacgtatcttgagctactggaaggaaataaatgctttcgaacaatcaaataagttaaatgagggaaacaagagattctcattctacgacggtccacctttcgccactggtactccccattacggccatattttggcctccactatcaaggatattatccccaggtatgccaacatgaacggtatgtatgtggaacgtcgttttggctgggatactcatggcttgccagtggaacacgagatcgacaagaaacttggtatcactggaaaggaagatgtgatggccatgggtatcgccaaatacaacgaagaatgtcgttccattgtcatgcgttatgctcatgcctggaaagataccattggaagactaggtcgttggatcgattttgagaatgattacaagactctttatcctgagttcatggagtctgtgtggtgggttttcaagcaattgtatgagaaggactctgtttaccgtggactgcgagtgatgccttactccactggctgcaccactcctttgtctaattttgaggcccagcaaaattataaggatgttaatgatccagctgtcactgttggttttagattggtagatgatgagaatactttcctggttgcatggacaactacaccatggactcttccttctaatattgctttggctgtaaacccagagtttgaatacgttaaaatttatgacgaaaagaccaagaagcactacattttattggagtcattgttaaagaccttgtacagaaaacctaaaaatgaaaaatacaagatcgttgaaaagatcaagggttccgaattggtcgggctgaaataccaacctttgttcaattatttctatgacaagttcaaagatcatggttttgtagtttacggcggtgacttcgtcaccgatgacagcggtactggtattgtccaccaggctccagcttttggtgaggttgattttgaagctgccactgccgctggtgttattgatgaaaagagggttcctcctaaccctgttgatgacaacggaaagttcagttcccaagttccagattgggagggggtatatgtcaaggacgctgacacaaagattatcaaatacttgactgaaaagggaaatattctattatcttcccaaatcagacatagttatccattttgttggagatctgatactcccttgctgtatagaacggtgccagcttggtttgtccgtgttaaagagatcgttcctgacatgttgaaaaacgttgaagctactcattgggtcccccaaaccattaaggagaagagattttccaactggattgccaatgcacgggactggaatgtttctcgtaacagatattggggaacacctattccattatgggtttctgatgattttgaagaaattgtgtgtatcggttcaattcaagaactgagagatctatctggcaaccaagatatcactgacatacaccgtgaaaagattgacgacatcactattccttctagacaaggaaagggcgtgctaagaagaatcgaagaagtgtttgattgttggttcgagtcaggttccatgccttacgctcaaaaccactatcctttcgaaggaaaggacgagttcagctccaaattccctgctgatttcatatcggaaggtcttgatcagaccagaggttggttctacaccttgactgtgctaggtactcaccttttcaacactgcaccctacaagaatgtcatagtttcgggtatcgttctagctggtgacggtaaaaagatgtccaagcgtctgaagaactatccagaccctggaatagtgttggacggttacggtgccgatgctttgcgtctttacttaatcaactctcctgttcttagagccgagactttgaagttcaaagaggaaggagtcaaggaagtagtttccaaggttcttcttccttggtggaactccttcaagtttttagaaggtcaggtagctttgctgaagaagttgaaccaaattgactacaagtatgatcccgaagtcaggagtgagaatgtcatggacaaatggttgttggccaccattcaatcgcttatcaaatttattcaccaagagatggctgagtacagactgtacactgtggtccctaagttgctaaaattgattgatgacttgactaactggtacattcgtttcaaccgtcgtcgtctgaagggtgagaatggtgttgatgactgtatcaaagcattgaacacattgacggaagcccttttcactttagtccgtgctatggcacccttcaccccattcttgtctgagaacatataccaaagattgagacctcttatcccagatgctgtcttgtctaagtacaccaaagatccaagatcggttcatttcttggcgtacccagtcctgaacgtatctctgtttgacgagaagattgagattgccatggctcgtatgcaaaaggttattgattacggacgtaacatccgtgagaagaagaccatatctctgaagaccccactcaaaactttggttattcttcactcagatccaggttaccttgctgatgtcgaatccctaaaatcctacattaccgaggagctgaatgtccgtgatgtaatcatcacttcagacgaggacaaatatggagtagcatatggggttgtcgctgactggccagtattgggtaagaagttgaagaaggatgcccagaaagtcaaagtagcgcttccttcagtgagttctgaagaagtcaaggaatttttgaagactggtaagattacagttgctggaattgagctctcatctgaagacttgaatgcagttcgtggtctgcctgagtccaaatctcaagacggacatgaagtcagaagtgacagagacactctggttatcctggacactaaagtgtatgaggagctgaagacagagggtaccgcacgtgagttggttaatcgtatccagaagctacgtaagaaagcctccttggatgcaactgatgatgttattgtacaatatgctattacaaatgataccattggattggactcaataatgaaacaacacgccgatatgctaataaagacctgcagaagaccgttggaaccgttggccgagacttctaaggacgtaattgctgaggaggaatgtcagatccaggacacgctcatcaagatccgtttgcttaatatctagacccacttaaagtagtatagaatgctagaataaagaaaaatctctgtataacgtaatactcgaaatccgaccctgaaaaattggaatatttgtaacgaacatccatcaccaaaacacaccacaagtagatgtcatttcttagttccagcaacgtcaacgtaacgcagggaacagtccaggaccttcaaaatgacgtggtggtaggaaatggaccagaagattccatcagtgatttggccttctcaccacaggctgaactgctggcggtagcttcgtgggacaagaaagttagggtttatgaagttcttccaactggtacgacggaaggaagagctctgtacgaccacgagtcccctgttctagctgtgcattggtctcccgacggcactaaagtggccactggagccgccgatcgtcaagtacgcttatatgatgttcaaactggtcaggttcaaaacttgggaatgcacgaggctccggtcaaagcacttagatttgtggaagtgggccctacttctacacctgtggtagtatcaggaggctgggataagactttgaggtattgggaccccaggtcagcacaaccgatggccacagtggcactccctgaacgagtatacgccatggacacttcacagaaattattggtagtagcaacagcagagcgccacataggagtcattgatctaaatcaaccacaacagctgttcaagcaaaccatgtctcctttgaaatggcaaacccgtacagtggcatgctatcctcaaggcaatggttatgcaattggatcgattgaaggaagatgctgtctacaatatattgatgcaacagaacaggcaaaatctggcttttcatttaaatgccaccgagtaccacgacccgctcctgccaaggagtcagacgtttactccataaactccattcgatttcaccctgtctatggaacattttctacagcaggtagtgacggagcattccatttttgggacaaagatcaaaagcatcgactgaaagggttccctgccggacctactagcatttcgtctacagcattcaacagaaatggtggaatttttgcctacgcttattcatacgattggagtaaaggccctgaaggaaattcagcaaatactccaatccaattacgtttacatgctactaaagatgaagaggtcaaacagcgaaacaagaagtaagggagcaagtgtaatattagggcgtagtgcattggtttattcattcgttgggcgaacggagaatttcaaatgcgagaagggggagttcggaaaaataaatgcgccagcgtagagcggaaaaacgcaaaatagacgaacctttttatgtctctagtctttaacatctatcttgacttcccacgaaagcttttccgccaatctccgttcagcttttctgccatagtctcacgccatcgccgttctgctccttgacgcgcatacgcaactaaatagtactgtatagattgtgaaattctgagttcatttcgcggcaacaccaaggtttatggtacatccaacatcaccacacaaatgctggatgaaaactgctcccttacgccaataaaacctaccacgcaagctgacttttgcctacaacaccaattaacgccccaacagcaatcttaatttcatcaatacacagtgaattgtgcttaatattgttcacagaccatttagcgtttttgtctaacgcctattctttgtattgacttatcataatgaacaagccaaacgggtctgaacaacaaccaccgtcacgcggaatgaagcaagagtcaggaggcccagttacttcatctacgacgccgggtaccaatactggcctagaaaactctcattccatgggggcggatatggagcctgatgttggtgctacctctcctcgccatcttcttaatgggtacatttacgattatttagtcaaatctaacatgcaaaatttggctgatcaatttgcccaagagacggagctcttagaaacagacttgacagtaccaatggatacgccttcaggctatcttctagaatggtggatggtattctgggaccttttcaatgcccgcctaaagcaacggggttcacagaaggcccaccagtatattcagttgaacatgctacgacaacagcaacagaggaccatgcgaaatacagcccgtgttcaaaaagtcccgttgaggccacacacccaatcatctccttcaatgtcacagacttttattccacagcagcctcaacagcaagcacagggacaacagcacgcccaggctcaagcccaagtgcaagcacatcagcaagcccaacaccacgcgcaggcacaagtgccagtgcaaccgcaacagcaccagctaggaggccaaactcaacagcagcaatccattaacactgggtctcctgcgggtccaaatgctatcaactcgcgtgttcaacacttagcacaacaacagatgaatcaccttcgccagcaggcgactgccactacgcaacaacctatcccgcaacagaatatcccatcaaaccaacagggtcctacaggcccttatcctacttccccttcaagaagaccgagattactgtctaacgaatcgggtgcaagtgcaccctctgtaatgacaaagtcacagctccaaggagtccctccctcacaacaaccacaccagcagcaaggtcagcaggtaggcccccctaatcaacatcaaggtcaatcttcttccttttattcgggcatgcctcctcaaggggtcgtggttcctcatcagttcaatcctcagcagtatgccaatatgctagcaagacaacagcatgtacaagctcaacaacaggttcagttacaacaggtccaacatgtacaacagagacaacagcaagaccaacaacaacaccgcctgtccgccggttcaccggggcacccttcatttggcgtttttcaacaacctcctccgatgtcaaaccataatcaggtcatgatcaatcagcagggagaaactttttttgatccacattctccatatgctcaacctaacgggtacccccagccacagcaacaacaacaacaacagcaacaacaacaacaacagcagcaaccgcaacagcagcagcagcagcagcagcaacagaagcagcaaccaccaccaccaccacgacagcctcagcgccaacaagcgatggccatggctcctctgcctcactctacttctgccgccggtactcctcactcgtccaccacacctagattctcgcaacctggtcctgtttatcagcagcctttacctgcatctcaaccgcaacattctccgccttcttctattcagcagccggagctagttccaactccagggtcacaacatcagcaaatagcacaaccacaatcacagagccaacaccagcaatcgcaacagtctcaatcaagtgcttctaaaattgtaggtatacaggagtatcagaaagagctaatgatgcttgagaaacagaacaaacagcgtcatgacatggcatgtaagaagggaagcgggcatttttctaactttgatccaattccagagcacacaccgcccgaaccaaaatttaatgtgaatgtaatgctccctccccagaactctgcagtggtcacgaagaatactcccggaacttcacctggtacacaaactcaaaacactgcacatagtactggtaacacttctgcggggtctacaccaaataatgtcgcacctgtacgaaagaaaaaggagccagctaaaaagaaggcaaagaaagctactgagcccccgactcccactactccacagactccaattgcagctaggacacatcaaaactctacaggcggcattcctggtaataatgctgctactaagcgacgaaaacgggagccgctggttgatcaaactgtttcacctaaccttaacgaagcttccaagtcaacaaagaccggaaaaatttcatctcaaactgactttacaggttctgacaatggattcttacaggattttggcgatggaactggtcctcccactggaaccgatgatatggaatttgattttaacagttttcttaataacgaaactggcgaacctaatagttcaaccattcattttgacaatgtattcaattggggagaaggtaccgaagccggagatttatagacatgaaccattgtcatactatattaattcatttcaattctacgaatgtttttaccaccttaatattactaattgtaaatttatgtattctttttttctgcagggaccgattgagaaggaaataactgttcgttggtaaaaatgagaatcaggataagtagtaagatagataccaacaacgcggaactttgttctgtagctgggaaaaccaaccagcaatactcgtgagcggcataaacaataatagatgctataaagttcagacgagccttgtaaaggagatatggcaaagagaacgcataccagcttaggaactggtagtgtaaagatcttgcaaaaagcacccctattaagttggtagtagccatgacggtgtaaacaaaatctgggcttctttctgggtcgttgataatattggttggagataaggttggcttccaaaatttgaaaatgtccaacacaaatctaccaagcggttttccaatgtttttaggagagaggaacttgaggatgaacaagactaacgtaataatatggagagcaaacaggagctggtgaaaatggacattgttgaaagtttcttggctcaaaaagcgccaattaaccgtccacttataaagaaattggcgactaaagtcaaaagcctgtctaaagtaggcagaacgaatttcatttgcctgatcatcatagtgcaacggtaaaatgaacgaataaccgactcctacttgcaccaatatcaaaactagaacaggtgccaaggctttaatcaaattttcgtcacaaatgagatatatgagtagtaggaatgctgggaggtatagcagcgcattcatctttacagagatggctaaactgtacgtatctgcagcaatcagggacaagataaatggaatagttgtgccatctttcctccagtaacttgcttgttgaaggatgattatagttgccaacatcaaaaatgttgttaaacagtcattgaagagtctcaatacaaatattgaatgcagtctcttggacgctaccaacaaaacaaaataaaccggaggtattttccctaagccagagaaaaagtaggagctgatggatagtaacaagcaacctaggtataaccaaccaaatgcttgttgaacgaaactgacgtcttctccaccatcactgtaccacgaaagtactgagtaagcatgaacatggccggctgggtaaaccaatggaccggtgtcaccaaatatgttgctataatctaattctccttgtcgaattttaaagatttgttgcatatatgaagaaaaatcaatatctgtgtaggaaacagtgccaatgatcaccttgataacaatggaatcagctaaccataaaagaggtgcaacgaagacactaaaatctgggttaaataaaacgttttgaataagagccactaaatcaccgataacatttttcagcgtaagctttggcctttcagctggctctatcggaggcatggtagggatatgttgtgaggtagaaaccaagcgaagtatcgagggttatccagataattacagtagccaagataagaatgagaacaaaaggagataaggcaaatacgaggggaaataaataatttgccgtcatggtctgctggggccttagaaacctatactgttaggacaatcactgttgcgctcaaagtgtgcttttcgaaatagttgtatctggtgtgtacgtttatttctgtgagatattggcttgcacaggatattgccacaacctatatgtctataactctatactacaattttttcgtctaatacaatctcaggtctgattcatgcttgggagagtttccaagcatttcagttgtgctagacaaagattatcaatattctttttgaatctgaccgggtttttccgttctttcatccaactgaaaaaataattatcgcccgtaggcaactggtcattgacgaaattcgtcaccagcagcccagattcattaatcataaagctgtgtatagccttaagttatagggaacattaaggctgaggcacaaaatatcaactgccttcggtctgataattcgaagcacttctcgaaatcctgtatccaagccagcccagtcacttaattatatggtacaacaggtgtctctggtatctagaatccaagagtctcaactgcagttgatcttggagacgttgaagtctctaacgggtatggtgcccgcaaggctctcaacttatactgttattttaactccaaagtttccttatagtcctgagttccagactggaaaagtcaaccaaatcgaacaatacaagatgagaatgtccaccgaatggaaacaggacgttgaggatcctattgataacacaattgaattaaaagactttgaattgtttaataagaaacatcttgaagctcttaataaggaaaatcgtatatggacccttcaaatatcggacgttcctttggcaggaaaaagagccgtttcttcacagacactctacgagtctactatatgtagcacggatgatgtggttggatatttagatgagctaggatacatgcctgaaacccaattttggactcatggttacaagttctacagaaacgatatagtcattgcaatctaccgagtctttatgaaacagaaacaggaaagtgctccaaattccaaagaaaataccgctgcagcaactaatggatctaccagatcagatactgctatcgaatctaagaatactgacggtatgaaaattgagctggacatggacatagatatgaagatggatgtagattctaatccagagagtaatctggagaccaaagaggaaacgatagaaccagagactaggctagagctcattgacaaaagtagagagttttttatcaaagcatacgtgaatgtagctaagatgagtgatgttgagaacttgtcaagggctacttcgctgttggaacatctgaaatcagaattagaggggttgattgaattctccatccctaatagagcatcaatggatagtagaattggttccagactcgctagtagcatatagtgtgctaatatcatttaccggatagtagttaccgacatcagacatctccttctcggtctttagaatcgtgaaatcttgcatctactctagttaaaactatctcaggtttttccgtatccgaatcgttccatgaaggttggccctagcttttttcttggaaatattggagtctttggaccaagagttatggcttctaagcctttcttatctccggcttttaacaatgccttcaaaaggatcacagttcaatcatcatctctagtaactaagatacccaagattaaccttagaaatttcgccaccttcaaccaattgagaatgtctggatctagctggtcaagaggaagtaacttttccaacttaaaaacagcagctttgttctctttggtgttctgtgtcggtactacatttgccactccatatctaatgaagtataccccactggcgattttcaataagaacccaagtttgcttgtgtacagtttgattggaatcaatgctgctgtttttgctctttggaaggcgcctcaatactggagggtcctcagtcgttatggtcttttggagaaagatgctaggttcaataaatggtcaatgattggatctgctttttcccatcaagacttctggcacattggtatgaacatgctagcgttgtacagttttgggacaacagtagccagctatgttggtgcttccaactttttaattatgtacctcaatggtgctgttctttcatcacttgcctcattagcctacccggtactggcgggtgtttcgtctatgggcgctagtctcggtgcttcaggtgctttatttgctatcttgggctcattttcatatttgtttccttacgcaaaaattcttttatttgtgttccctatcccgggtggtgcttggattgcattcttggcttctataggatggaacgtttgtggatgtgtgttcagatggggatcgtttgattatgctgcccatcttggaggttcccttgtcggtattttctatggttggttgattgatcaacgtagaaaggagttcaagaagaataccagaactgtatggtgaacagtttgaacgctagagatggtattgttgcagagtatagtatcactatgtacatatttattattttcattctttacctaatttttcattgacaacatagaagccttctgatttaactgaagccaggtctaaaggattccattgccctgtttcacccttctttgaactctgtctaagttcaccagtagcgttacgaatatcttgaaatttcagaggagaatgttgagtttcaatcaaatcaaactccttgcattctatctcctgtagtttgttcatcatggtcagttgtgcattaaggtcatttagtagttgtctttcctttccagcgtctaagtccgtggacaacccagatagctggagaagcctgtgaagtttgggtgtatcaatttccaaggatttctgtgagcccttcaaaagggtttttgtgtcccatgtaggttttttcaagtactccttgatctgctctaaactttgaaacttttgacccaccctggagctgtaattcctcacagctgtcctgaacatgtaggatgctaaatgagtagtaactgatgcgcgcgatagtctagtgcctagatgcctgttacgtaagacgaataactcaaaagtttatatgttaagatcagttccatcttcaaaactgtactcttaatcttagaggtaaagtacgacgaaatggaaatttttacgtatttgttgatatactagctcatcatctttttttgttctacgttttggtcaattatgcctactctaagtatttccatactattcttccgggtaacctcatcgtaaaatttttttgaatctcctaataaattttcatttcagtattgttctttctcttagcaaatcaataaactagatgggtggaactgtaacaaggaaatacaaatccggtagtgccgttgatttcatcaccagagcaaatgcaatcaagaaacttcaagtttctctggccgacttccgtcgtttgtgcatcttcaagggaatctaccctagggaacccaagaacaccaggcaagccaacaaaggttcttcagctcctaccactttctactatactaaggagattgaatacttgatgcatgatcctatcttgcgtaaattcagagaacagaagacttttgcaaagaagctgaagagacttctaggaagaggtgatctggatgacgcaaagagattggagtctagaagacctaagtacaagttggatcatgtaatcagggaaagatatccaactttcatggactctcttcgtgatttggacgatgctcttaacatgttgtttcttttcagcaatatgccagctaatgacaaagttggttccaatgtgacgaaacaagctgaaaaactttgcaaccagtggttggcttacctagcaaaggagagactcgttagaaaagtttttgtctctatcaagggtgtttactactctgcgattgttaaaggtcaagagatccgttggttggtgcctttcaagttcccccagaacattccaaccgaggtcgacctaaaaatcatgctcaccttcttggaattttattccactttattgacctttgttttatacaagctctataccgacagtaacctagtttatcctccaaacattgacccgactactttaaaaacagttggaggtatttcaacttatgtcttagatcaaaaggacggagctcaatctctggttggcgacctcaaggataccaagcaagaaggaactcaattgagtaaagacgaactttccaaagccttggctgcagataaccaggctgaggaaactgaagctcaagaagaagttgaagaagagaacgtagaagaagcttcgctagacaaatttgaagacacaagcaagaacgctggagacaaattggagcagccattggaattcaacaatgctacttctaatttattccagaactttattttcttcgttggacgtgaagttcctttggatattttggagtttttaattgtgtcatgcggtggtaaagtcgtttctgaagttgctctagatgttgttggagcttctaattatgatctctctaaggtcactcaccaaatttctgatagaccaaagatctctaagaaggttcaaggaagaatttatattcaacctcaatgggtttttgattccatcaacaaggccactttgttgaatgagtctgattatgctccgggagaaactttgccgccacatctttcaccatggggagactctggtagttatgatcctgaggctccagttgcagaggatgagttatcttcgcaagaagaagaaggagaagaggaggttgaagaaggttccgaagaagacgaagatttggttgctcaaaatgaattagaattggaggctgctggaaaatacaccgatgcaggcaaggaatctaagaaggagaaagagaagaaggacaagaacatcaaaaagaagattgagaaggaagaaaaggaacaagaggaaatgaagaagtttttgatctccaacaggaaacgtaaagtatacgaaaatattaaggacgaagctgatagagaagagaagagacaaaaggaccttaaaagaaagaagattcaacttcaaaagtctaagaaccagcccaaagaagctgatagctaatagcattttgtaccatagaataaattaagtttctatttttttgataggcgtaacattactacagttgattgatgacttacaaaccttcgaactcatcggtctcgtcaaagtccaatcgttttctacctgtaccttgaagcgaagctaattctctggaagcaacttgtttctggactttcttggtcatcctttcaatctcttcctccgcattttccgcatcctgttgagcatactccatgaccaatctacgacctaacaaatgtacaccttgcagttggtccatggcttgttcggcctccttgagtaaagaaaattcaacaaaggcaaaacctctggccgaactgtcgaattttttgggcactcttgcagatttgagatgaccaaaggaactgaataactccacaatatcttttctagtagcttcgaatggtaaattcttaatgataattttacttgttttactggacctagctttcttctcgtttgttccagattttctatgagagagtttcaattgcaacctgtgtccatctaatggctttccgtctagagttgaaattgccagttcagcttgctccttcgttctgaactcaacaaacccaaaacccatggataaggtcttgcccggattcttcgcatcaggtttcgtcttaacagtggccacagtaaaaccttctagaggcttaaacgtatccgtcagtgtttggacagttgtgctgaaacttagatttttaacgaatacagaaacagttggtcctgatggagttaaagcttcatcagatttgtcagtgtccaaaagatcaccacccgtagctttgacttccttcccttctttcttttcagcaacatctggagcctcattagagtttggatctctagtgaacagacctgtagggcctttctccaaatatatgatcgatttcttgaaccttctgtaggccagcttggtgaatgccgatcttccagatggggcatcacgaaattcaacaacggcaatggtcccggcaggaggcatcaaaactcgttttaactctccatattgggcaaaaagatcagtaatttcgtccagagatgtaccataagggaaattttttaccagaatgactttgtcgtctctttccttcgtgtcaaattttgtcaaatcaacgcctttagattcgaaatactttctgacatccccaattacatgggcttcagcaagtgcctgtttcacagcagagctactattctgaggatcaatcaattctgtctttgagattcctagcttgtcagccacagacgacagtacagcatcattgttcatgtacagggaattccagctgaacacactttttgaagcgtcaactttctttttcaattctcgttgcttttttaagggcaggttcttaatgtcaaactcatccaatctatggtcttttttgggttgagcaggaagaatgtgaagaagtcttccttggaaaatttgtttatcaagggacttgtaagcctcaagagcctgttcgggatcttgaaatttgacataaacaaacccttttgaagctccagttctggtatcaatggctacgtggacttcatccaattctccgtatgttgaaaataattgcctaaactctgcttcagtagctgtgtaggagatgtttcttacgaacagcctgccagtttgagaaatgattttaatgttttgatcttcttcagattcttcttcttggacaatttctgtctgctgttgactagaagtttgaccgtcttgtgactgtgttgctgttgtttcctcctcgtcgtgccctggcctcttgtgttctgtgtctttggttccattttgttctttgtgggaagggttatcgctcattctttttcgtctctgaattagccattccaaatcagtcatactatcatctgcaggtgctacttcactaagaggaatcatctcttcctcctcctccgactcattgtcttcgtttgatttttggaagtcatcatagtcgtcatcactggcatgatctgaaacattagggtcatgctgagcactatctgtggtaggctctgatttatcccttttggctagagcttctaccaatgcttcattagttggtccaccttctccagaaacggcagagttatcagcccaggtttgtgtttgactacctggtctcagagcattcatgaaatctctcaatttgtgatctttagcaatctgttcgtcaatttccctgattggattggtcttgttctttttcataggtgcttcttccaatctctttaatttttcttcagtatctttgatcctgtcctcggccagtcttttttttgctttgaaactgagcggaacattagaatctgcaaaagtaactgccaactcaacagatattctggctgtatcaatgaaactatcgttgtagtaagaagcggctttttctgcatcttcagcgtttttataaccgatgaaagcaaatcgccttgattcaccaaatcgatttttcataagtttgacatcagagacgtctccctgcttagagaaataagcctttaacttatcctccgtatagtactttggtagccctttcacaattagtcttgacatcagttagtgaaaagttaagtttagagtctgatttttataccatagtatttttttatttttttttttttttttgagggcacaacagaatcttgtaatgggctagtacatattgagccgcatacaaaaccatcagtctacaaatacaaagtgtaccgacaacctttttaacctgacggactgatggaaaccctacaacagatcggcatctttgacaaagatcgcaagtttgttgcctacaaatactcgcatgctttagttcccctcgggattctcgttttctacgttgtaatctatcatatcttgtcatttacgctgatcgtacccaaactagcgtttgcggaaacagcagaccgatttagaaggcgatcagcagctaatttttggcgattggccaactacatgctaaaactaaactgtgtcaaaattgagataacgggagacgagctggaggttgattctgcggttctactttccaaccatagatcaatcgccgactatattgtgatatctgccttggcccagagtctagaagataaaggaaggccagaaatagacctggtatcagtcaaatttttttcgtggttcagcttgtggggacttcccaatttgaacgttttcaataacattctgagctgtgatgagaattgggaattggatactagtacaacatacaatactttcaatccctctgtcgtatcgaccaaacctgaatggatctctgtttttccagaagtgaatatctggtctgctgaaaataacgaactgctgaacgaattgaacgaaaaatactacctcccaaaactgcaaaacgttctgtatccgaggttctcgtccacgttcaatgtgatcaatggcctttacaagtcctcttttagtaaattgtatgatatcacaatattgtactataaaaagaaggcagcagacccacaaaaaattgtcaaaatgtcccaaactgaaactgcgatacaactggaaagttcaggggaaccagatgaaatggttagaactaccttgtttgatagcccaagtctgttgcaagtcttaggtgagtacccctctagctttgttgtcagagtccatgtcaaattgaaggccctaccaagaatcccactgaaaaggaaaaaactagaaaagtggcttgaaaaagaatgggtagaaaaggataaactattggaacagttgcaaactaccattttaaccaatcatctaaaggaaaaataatattaaatatgctgctgaatatcaataaattattggttgattgacgattttttcaattcctcagctaattcatcaacaacttcatcgcctttggtaatctccactccagcgatttctctgtcaagtttttcctgcaattgatccaagtcggtatcatcttcttcgttgtcagtttcttcttcctcttcctcctcatcttcttcctcgctgtcaacttcttccaaatcatctaactcgtccagttcaccggtacctctttcttcaaaaattgagctaagcttctcgatcaatgcagaatcttcttcaaaacggttaccattcaattccaaaactttcaggtttgggaacttgtcaatagactctaccaacaattctagggaattggcttcaagttcattgtattgcaacttaagaatctccaattctttactgacatccccttccttcagagctttagcaaattcaaaagaacctttggggttcagtaaacagtcgtttacattaatttccttcaacgaggaccaactaggaagggaaacactaagtgccttagcacctttaaaagtgaaagtattgtcctgcaaatcaaaaacttttagttcggtatttgctttcaatccttgaagaattaacttgcttacaccggcgggcctaataccattttggtacaatctaacactctccaaattcttatgggctctaagaccaatggccagatagttaaccgatccactttccagtctgttccttccacagtagaaagttttcaaagagtcaggagcgttttgggtcttggatttggcaacactcaacttgtacaatgattttccgattctagaaccagcataaggacccataccattattagataggatcaggtgttccaaagaaacggcctgggccaagaagctctcaatcggatcaattgtttgcaagccaaatgcattatcgctgagattcaacacacggagtttatgacattctagcaacgctggaagcagataccctagagatcttggaatctcatcctttaaccttccagtaaagaagtcagcaaaattaacttcaacaatggtttcagcatgcttcaataacgcttctgctaacaatttacttggatccacgccgatggtgttgccactaaagtcaattttcttcaaatgaggaatcttgttgagctcttcaagatatggtgatatgtcatcgggggtgtcaaatttcagtgatttgtttgagatggagtaggtctcttcttccttgattcctagatcaataacgaactgagtcgccatgtcgccgcttattatgtgttacgtagttgatgatgagaaatcaagtatgggaaaattgtacaagctaaaaacgtacacatgaaaggacatgttactgccgtattcggaaatatatatcatttatttcgaaaagagttgtcgttgctggaaaaaagtatatagtctatcacaaggaatgaagtttccaaattttcaataactctacgcttgccttgttacatataactttatgattgtcgttagtggtatattgagacataaaaaaatattgtattcatttagttcttctttggaaataatggatcaccgatgttctttcctcttaacttgacccctaaaactctctccatcttagccagcaactgctggttagggacagctctaccagcctcatagtcgttgacaacatttggtttttcgttgatctttgtggccaattctttttgggtcaatttcttgtccaatctcgctttagagatggccttaccaacgttggcatcaatcttctttggaggtacaacgtctgtttcacggtcgatcttggttaacttctggccctcaggatcagactttgaattaccgctgccatatttcttttcgacggctatgacgctaccagttcttctggcttcattgatggcacctttagttctggcgatgttctcacgaggtccggagcctcctacacgggcttttcttccaataacggtaacagagtcccagtcttcagacatgattaattattgagatagataggattaatagtcaggatggcaaagcgatgtggtgagagcgattcctggagaacatcagagaaggttcggggctaggtcggaaataatgaattccgggaacatcgtgaccggaacttaatctcctaagcatattttggctcactagacattgaagctgcgttaactattaccatcggtgctggttgagccaatggctgtagttgaccatggtgagagatgaacttcgtagataacctaaaaagttgcttattattaaaccctgcgaatattgggaagagcgcaagctaactagtacccagacccattgactctaaaatggaccaaattctttgcaccttgtcacacacttttgatgtttataccgatatctggtatgttaattgggataccacttgctaggtagcctcaatgtaatttggatagtactcctgctgatcaggtgttcttaggctgctcaactgcaacggtgaagcgcgaacagagttatctaacgggtcaacagtgaacgcgtttctttagagggtccgaagagatacagctaaccatttattgatcaacatatggatctaaaactccatattccttcgggaaatctggaatctaaagaaaatgaacctgatttttatgatctgttgtgccaaacagagaataagacttttgccttcttcagtgatacattgaaaacttacatcgtattgaaatcaaatgtagtgagtcaagaggaatttcaggatatggtccaacagtacacttcaattgatttcaaaatcactttatctgctcataatggagacgatgatattgaccctgatgttatagcttcggcccatctagatacaacaaatatagtgaagcaaagcactcttgaaaatggtacacattatattatctggcaatacagtactgatatcaaatatccacaaaggaaaatgatcaatccctcggcagcaatttttgtcaggttgaacatcaagtctagtgctccatcaagattacagaatggtgattctgagcagaatcaagcggaagaagctcttatttcttcgaacaatcttctagctggaatcaatagtggaataaccacactatcactatccgatcccattatatctgaagatatgattgaagatggcgcaaatggcctcaatcttaacaaaagtttaccctcaatagactctgtaacgtcgaattccttagacgaatccagctttatcagaagttcttcgtctgaagtggtcgatcacagcaacaaatcacttctacttcaaagtgaatactccattcctttgctgtcactcttaagcatgagattaaaatcaaagaaactaatctcctcaaataatagcatattatccacactagagattcgatctccaaaattcacaacggagaagaatatagtactggaggtttctagcgtcaatttagtactttccaatggggatgtggaaccagttgaacatgatagatttcccttgcaactggagcccggaagcatactcaaatctctttaccgactaacaaataatgattctaagtcaatgaaattggtttctatacaagtcttagccaagatgaaagaaaaagtcaaaaaaaatttatatcaggatattagcactgccataaacaccaagtgggatactcatatagactttgcagtcccaggaacagtacccagaccgtccactccagcaaaatcgtactcatcgccaactaaaccaacgacaccacagtttttgggcaggaagcaagaccttaaactctccttacgaaatacgagtgtagcaaatttgaaacaaaaacccaaacttccagcattcgcaggactcagcatctccttctcgagccctagcaaagtggctgtgggctcagttttcaagtggaaagttcaagcaatcaacaagggaaatgcatctatgaacctgacattgattattcaaccaccttccgaccttatctttgagaaaaagatgccagatcctccttctataaataaccggactgaactacccatattttcttcgggtactttgtttaaatcatatcaaagtttgaaaccgacaactcatggaatcatagcattgcgaaatgacattaatatcggtcctttggaacatggagcgttatatgaatgtgaaattgatcttctagcttttgagaagggcgttcatactttaaagggtctcaagctggttgatagaattaacaatcagatagtagaatgtggaagactccctgttttaattgttaattgaaggtacctatgtcaagaccaaaccatgcagtattagatatttttctatttttctttaattgaggtctaagctggtatctaatatatgtgagccagtacgcagggcctttttttctctgagtggtcaagtaattgagtacacaaatatgaatatagtctcgtttcaaccgtgaatatatttgtaaagattcccttgaatccagtaacctgcaaataccaacatcaactactttgacctcaaaactaagaagagtcttcggtattatggtactcttccttcttatcgcttcccttgtcgttttttctcattcttaggaccgacagctcgcttcaaagtaataggtttttgaccaacgtactttccgttcatctctttaaatgcattcaaatagtcttcggaagaagcgaaagatacaaatccatagccctttatcttactcgtcttctgctctttaggcactataacgttttgaagacttggatattttgaaaatgagctaagaagaacctcttccgtgacatcttggcccaaatttccaacaaatagtttgaattcagtagaattggaagtggtaggcgaatatgagggtgacgcacctgaaggtctcttgatattattcagtatagttttcggatctttgacaaacgtcgacgaatcaaagttccttgagctatgaaggtactttcctggttgtctgccagatgctgcccttctatcagacgaggcgctgggtttcgttaccctcttggccattgcagttatctttagtcttcggtgaatagtcttaagaggagaaagcactacccgcgatctattgtttaattgatatttcaactcatgaattattatctcaaccatggtcgcctcaatgggtttaagggctaggttcatcatgccttttgggcagatgaggtccatgacttcattctcaagaccacttacagttttttcgtaccagttgagattgcaccagcccaattcttgcttgcgtttgacaccatcgagagcaaactcttcggtaccccaaaaaaaatctaaaatcgaagaacctccgattcaaattgacaaaacaaccttacataggataccaggtgaatcagttcaatctaataaactgattgataggattcccaagtttccactcagcaaggaagctgttccaacattgttaccaagaccaggagttccaatggtaggtccaaatatgcccttccgcaagatggtagagatattagaaagcaagtccgaaccagagctgatttatgaagcagagccgcatagactatattttgttttctgtgcttgttttgctctagtctttgctgtctacgggatcaatgttctaactattggaatggaactagcatggagtacttttgataaaaatgaacttgccctacctatggcccctaaagtggttaatttcattgtgcaaagttttttgaccatcggtctggcatgttttcccttgggatttgctcttttgtttgtttatactcccacgagattggtgagacgactgtggtacattcctggctctaaaggggagaagcctttggttcagattttgacacatcccctagttccgtctagaccttcaccaattataagcattcccgttgagaaccttaatagagcacagacttctaaggtatggacaggtagaggtttctatggaacggtagactcgactatattcttcttcctgagggagactggtcgcaggtttccatggattgtagaccgaaagggtttcttttggggagatggaagaattcacgattatttgtttggaaaagaaactattgaagaggccgaaaagggattatcctacgatcagaagattggtatcatgaaccaacgaaaaaaggctggggaagagaagttgaagaaggaacttggtgtaggatggagatacaaggctcaagccaaactactcaaagaggacatttccaaactgaaaaagattgtcaagcaggttccaggctccaattcggaaaagaaaaagctcaaatagacccactaggatatactgtatatagggagacaaccttccattcaaaatccgatttgtctcgatctcggcttaccctgcctttttttttttgtagccatctcttctagtccgagtttcagtttgacaccccaacaacaaacccctttgttgttgttgttttatcatacccatgcaaaagagacgcaacctttacgatgaaaccgcgtgtaccacgtgaaatacgttatcttgttttggtcataataacgccacccaacacattcgcgaaggtgagcatgcatagagaaggaggggggtctggcgtaataaggagatggcagcaatggaatgaggcagctggaaatccgcaactaaaacatttaatttctttcgtgttcagttttttcccctcaacagaatttcgtttcaccttaaaaggataacgacttgaacaggttgtatttcaccgccatttgttagttaatcagtcgttgagaagtttgtcccgtttttgcctcccttgcttgtttgtttagcttagcgatcggggtcctcttccaccttcccacccttctttcctgattcctatattcaggatcgtgcaattttttttttgtaaagctctcaaccttcaaacttagagcttcatatgatggcggcaaatattaaaccacatgttcggcctaactctgtgaggaagcgcttgaatgagtcgctggaaacaaatgaacgtgaaaaaaggttttgctccaggaagctacacgattttgatgatcacgatagtatggatatgcacgctaactataccactagccctatagaacgcaaaagatcactttcaccaaacgctcccacgtcgccggtgactgaagatgatagtgatgctaagccactggaacacaacaaacagaatatccatgagctggctgacaacccagattatatagccctatgctccaccttatcattgctcaagcaacagcgtggacttgtaacccaagatattcagcgtcttcaagaaactaaaatggaagcaatgcaagacccaagctcgtttctacgtcgtctggcaacacgccaggttacattacctggtctgaccaaggttattgtcagtccatcgatacattggtccaagtatggctactcagaagacttagttttcaagaaaccgactaagaaaagcgatcggcacattgtattcaaagagagcaaattttttgattgatcatgagcagaattatcagacttatctcacagcacaccatattatcataaacacagtaaacaaagaactgtcaaaacagcctcaacatatcatataaataattcttccatttttgtacatactgaatacacgcagagcgtcatcgatttcaaagttactggcttagctgatccaagctctccttcactttttgaggactggctccaatgactttgtgggaaatatctccattggaaaaaaacccgaaagttggcatggcggaaattccatactccatgacaatgtcctcgttgctgtcgacattaaccttgtagaatttaatgttctttttagtgtaagcgtcttcattgctgaatttgtcaataatgggcgcaatggccttgcaaggttggcaccaatcagcgtaaaaatcgaccaaggctggagattttgactgcaaaacggatttcttgaactctgccatcccgtttagctctacgacttgctttacgactctggtgttagagaagaatctgacgtttctgatcattttgctgtacaggagaagacgaagaataattggatttgtaagatggatagaaggcttcgcgaaagatttacactacttagtcacaaaggcatacatggtaaagtgatacacatataataagacacaatgattcgacttgatcatccgacatgagccaatcagctcagttctcttcacggttgctaaggatacgcaaaatgaagaggaataagttgatgatgtccaagtatagcatgatagtggccacaatctcctcatcgggatgacatttggtcaacactacctgcgtgtcaatcaatatgaagagagagaatatcaaagctcccaaacaggagtataatagttcaaatgtagagctgaatggcaggaataacgataccaggcccacggaaaacattccgaaaagggctatcgaggctatgccctgccattgtgtaaagtcgtattttgtctgtattgtgaatagtgttaaaccgataaaggtcaccaaagtaagtaaaattgcttgtagaacgatattactgtcgtataatgaagttaccattccaataccataactttcacagatggtaaatccgagaagcaaaaacaaattgtagggatatgacttggatttccagtaggcgaatcctaaaaacgcaatactgcctaccagggagacgtagaatagccagatattggttaaacaccatatcttaatgctatcattattgtaaatgatgaacccagtcaggaacgtagtaaagagttggatggatagcagagtataaacctttcttatgaagccctgtcgtatttgcaactcacaaccagacacattgacgtcatacttgaagtctggaggtagttcactaaacccgctggggctggcattgtcgtcgtatggagatacttgttcgtaagttggtggttctcttgacatgatgtatgttcaaatgtctacggggactaataacgtggagatgagggaaagaagaagaagaaaaaggaagcatgacgagcattaattcggaagcttatcaattcccgcgattacataatacgacagaccatttataaatatagatacatcaaagtctctgctgagtggttgtcttcatagagtaatagaacgccgtctctgaggtgaaaccggaacccgaatatgaatagttctctaagatgatggagcttcttcagcaactcattcatgtaatggttgcccgagttggtatttaggaggaactgtttcaagaagatgcgaagcatcgggttgcgagatctccaatcattgacaaacttgttagaagaatacaccatagcttgatcaaaactgtcaattttatgtgtaaacacgttgtaattcttgtaatgataattgttctgttcgattaattgcaccgatgacgtacatggtacatcgttctcttcaaaccagttgtccatgtacttgataaaattatgttgcagagtcaagtcattgtaggaaagacactcgattgattgctgcttttcagtaagataacggttaatttcctccacatcgtcgaaagttattgacgtgaatgttaaactaaaatgggttatttggttttgagagaggcgttcacccaggaaagttaatagtgactgtctctggcaaataatacaattcttagtgggtttcaatgttagatatttcaaagaaggcatggcaggaatgcgcaggagaaagcaattgttggtttgtttgttatcctcactgctatcaatagaatggcctttaaacttgtgtgaatactctttgaattccaggtcaaggctttctaacttggaaaaatctacaattttttccaaaagagtcaccacttgctgctgaatggtatcaatgtgacatttaataattcccaggtgggttaaattagagaagaagcatttgttagattccagctcattgagtaaagtgagccagttgaaattgggcagtttattatcaaaactgaattcattggttttgatgtattccaatgttaatctccttaatttcggagctacatgtgactccttcaacaacttggctagaaaaactagctcgccatttaccgactcagaatcaaaaacattgatttttaaatcttcgactgatctgaaggtattcaaactataatccaaagtggtttctaagttgctattccctttacattggatcactatcctcttaactgtagttcctttcagcaaagtcagccacgagcttagacttaaaccatcgcaatttatgtactctaagttggtcatcaaagacaaacccagtgcaaacacatcactaaaagtcatcgttttcaagtcaaaaggcactccaacaggttgcagaaaatgctcccccaatatttcaggaattgtcttaccccaaacagaaccttcttcctgacagagatcaaccacgcttaagctttgaatcaaacgggccaggtgctgattgtggtacaatgtgaggaccagcctcaaaaattgtttcacattaattatggttgaactagtacacctgttataatggtcatgaacgtagttttcatttactatcactgtcacccgtttgtaaaggcatgctatcgatgctaagtaaaattgcttgcttgtagtgttaaggctcagcagcgtatccaaatcaagatattgaaatataactttgagttccccaaaaccaagttttggaaaatctgtggtgttcaaagtatcctgatgaccaaacttgaagggtagcttttgcagaaaggatggtcttctctctgtcttgacagcgtcccccatttttgaatggttagtaggagtggtcgacggagatagattagaatattttcaaaagcgagcaagataagaatgagcagcgggtggccaggggttgtttgcgcgcgaggacacctattttctgggtagcctgactgacacccaaagccatgagatagtaaaaccctagacttggtaaggctctcagttgattatgggatgaggtgttattccaaaaaaaacggtattctgaaagtaaaagcttttataatgaactgaggaaatttaacatacgtgtgtccttcaagctactactttaccccttcttttggttatgttatttttcactgaaaaatttcagataaacccaccccctcaggatctcggtttaccgtcaaccaaacctcagcagtatatatttctatcaatttagatgtctcttcttcaaacctggcttaaccctctttcgtaaaagtaaacgctctcatctttaaacatcctccttctggtgtctccaacctcccttccagattctcgaacacttacgagacacatcaaaaaaaattttcgtcttgctaccctttcttctcttcttttctaagactcccctgatatcttctgattatggcccctgtactcccaccaactgaagcagaaaagaacattgaaatttggaaggtcaagaaactgatcaagtctctggaagttgccagaggtaatggtacatccatgatctctctgatcatacctccaaaaggtcaaattcctttgattcaaaagatgttgacggatgaatatggtaccgcttccaacatcaagtccagagtcaacagattgtcagttctatctgccattacatccacacaacaaaaattgaaacaatataccaaagttcctccaaatggtttggtcgtctattgtggagatgtcatcactgaagagggtaaggaaaagaagctgaccattggtttcgaaccttttaaaccaatcaacacatctttgtacttatgtgacaacaaatttcacactgaggcattgtctgaattattagagagtgacgacaagttcggtttcatcgtcatggacggtaatggagctttgtttggtacattgtctggaaacaccagagaagttttacataaattcactgtcgatcttccaaagaagcatggtagaggtggtcaatctgccctgcgttttgcccgtctgagagaggagaaaagacacaactacgttagaaaagtttccgaagtggccgtgcaaaacttcatcactggtgacaaagttaacgtctcgggactgatcttagctggttctgccgattttaaaacagagctgtcgaaatctgacatgtttgacaaccgtctgcaggcgaaggtgatcaaagtggtcgacgtgtcttatggtggtgaaaatggattcaaccaggccattgaaatgtctgctgagacattagctaatgtaaaattcatccaagaaaagaaattgattacacaatattttgacgaaatctctcaagatactggaaaattctgctatggtgttgaggacacactgaaggcgctagacctgggtgcctgtgaaatcatcattgtttacgaaaacttggacattgtacgttacactttgaaggcaagcgacggttccaatgttattgtgcatgcttctccttctcaagaaaacaaggactaccttattgacaaggctactggaacagagatggatatagccggagaagaaccgctgttggagtggttagctgaaaactaccaaaactacggtgctgccttagaatttgttacggatagatcatctgaaggtgcccagttcgttagaggtttcggtggtattggtgctctgttgcgttacaaggttaattttgaacaattggtcgaagaatctgaagacgaatactttgacgacgatgatgattatatttagtctgtactatagatagaagagctaatgtgacaacaaaagatccacttgattcacttatgccttgctagattttttcttattctcagccttctttttcaaaaaagttaagacatcaactttttcctgtcccacaatttcctgatgacctttgccttttaaaagaacatctgctaggttgtaactgcctccagttaaatagcttcttctagaatcctttctaatagtcgtttgcaaaagctgttccagcttgtatcttttttcgttcatttccttttgactcaaagtctttccttcccttcttttcctgtctctcttaagatagtcatcctcctgtagattatcaagatcatcaactcccagttcttctgcagccaatcttacccaatctttttctttcctggctccatcactggttaccgtagcgtcggccaattgtgctgccaattgaactcttggattcagctgtgacataatagcttggtcaataggaagcaattgaatttcttctgtgtgttttttatgagcggtcttagccaaagctctcttaagtcttctcagtggcccacttgcctcctttggagaacataagatcacagcaacaccctcttttccagctctcccagttcttccagttctatgaacgtaggtatcagcagtacgaggaagatggtaatgaacaacgtgctgtattcctgaaatgtccaatcctcttgctgccacgtctgtagcaataagaactgcatgcttgttactcttactggcctgtgtgaatcgttctatagctctcaatctttgtttctgaatcattgacgaatgtagtccaaatgcagggattcctaagttttgcaaaaaaggtactagtcttcttacagcatcaatactgttagcaaacaccaaagtggtcccgggatacatcatcataaaataataaagatggagatctctctcagtagcaccacattcaatcaaagcttctctaacttgattggtgacaacttcagtgggatttgtatctaccaatgtaggtttttgtctaaatctcagtcgtttgcccagtagctcaataatttgttcatcctctgctaatccttgatcctcattccatctatattttgagcccagtttaccaaagagctctttggagaacgtagcagagaagaccaatgtttgccatctttggatgttatgaggtctcatcttcttcaaagatgacagaattttctccaattcgtcaaaatgcccgtcttgaagaagtctatcggcttcgtcaagtactagaacttcaacagaagccaatctagtggcaagttcgttgctggactctaaaagttctagaaatcgtcccggtgtagccacaataatccctggtccataatctaagagtctttgctgtctttgaatacttagaccaccagttactgatatgacaccgtgttcggtcaatggagagtctttagcaatttctttgagatgtttaaccacttgatgtgccagctctctggtaggtgcaaatactattcccgcagggggagcctgcttggatcttgattcccgggtcaaatatttttcaattagtggaattccgtaagcaagggttttaccggaaccagtgatagccttaccaatgatgtcttttccagatatagcaaggggaatagcttcgttttgaatgggagttggttcgttgaatcctaggatacttaatgactggcgaacaaaaggagagagtccttctggccaaagcggaaggtcaacatcttctggcattttcatctgagaaaatttgaagtggccatcctcttccataggtacttgctcgcttccagcatcttccaaatcttcctggtcttcatccttcttgacttccttcacgtcctttcgcttgacttttttgttagatttcacacctggtgttgactctggtactttttcagttgaaacactgtccaactcaaaattttcgggctcattctggtcatcttcccttccatctaaagattcagcatcttgaaatacctcatcgtcgtcactcatttgatctgtatctttgactgtctcattctcgtgatcctctttcacctcaaacttaatctcaccgtttttgataacaactccaacgccatcaatctcctcgaccccaaaaagaccttgaaaatcatctaaagtctctggaatttcaactggcttccactttaaacttgaggcactgactagctttccagtgggtctttttatcaccgcctttggcttaacaacagatgacttaaagttgtcctttctctgctttttgctatgaccctttttggatctgagcttttcttttggcttcattgaactaatgaggaaactgtctacaaacttttattttttttaccctgcaactttttttttaatctgtcgcgcgatgagataaaagctgtttggggtcccaaagagaaacgatcagatgaaaagaaagagcttaaaggctattacgaaagagtcaaaagctgtccatgttccttcaagtataaaaccacaaagtgccagacaactgatacgcaggtttcatttgttgttgaagaataaaaatttagtcctgcagaaacttcaatcatcagaagctgattatctcaccaaacttaaacagatagggacctaccaagtctactctgacagtaaaaataaagtgattgaaaacataaaaattaactccctagcgactgaaaactctgtcaatgttgagagcgtgcagcccttctttttgtcaggcttactcggtcggatcgatggtgaaatagtcaagagaggaggtttagatgcttatcaagtagcttccacgcaaggtcaaaatggaaaacgaggcggtgattcttctaaatatttgatgagatggttatcagagttagaactgttttccaaagtcaaaatcaaacccaatgccttggaaattgggtgtctttcttctcagaacctcatttctacaagtaaggtgtttgaagaagttgtgcgaatagatttacaatcacaggagccaaagatcttgaaacaagatttcatgcaacggccattgccaaagaatgacaatgaaaagtttaatctcatttcatgttcattggtgctaaattttgtccccacagcgtctgataggggccaaatgttgaaaagagtaaccactttcttacaggagacagattcttatctttttctagtcctaccacttccgtgcattactaactccaggtattgtacacaggagcatattgcaaagataatgtccagcttgggatttcaggagttaaagtttcaccaggcacagaaaattgcctattggctttacaaatggaatggttcaaaatcttcaacaggagaaacttttctgaaaaaggagttggtatcaggaaaagggatgaacaatttttgcatcgtcgtggactgaaatcggctgttgaaagagggtgcatcatagttaatcaattatcaacttacattcattaatttgaacattgcatgcttcaactcttggaagaactctactggaattgcttctatgcaaataggcatgtgaaataattgttgtgggaccagttgaccgttgatttggtcaacgatagccaacctctattatagcactgtagatcaccatttcgaatacaacatctgaccacaagaggtctgtcggaagaaaaaagaaagcaggccgtggaaaaactacatgatcgttcactactaaatgaaagggttgtacccttctaattttgtctgttacactgattgtgcgactctgatttaatcggcctgatgcaggaaggaaacatcgcgatttgccccgtgctactcatcttgatttcttcagttcagacgatctttcccttctattcaagtttgcaataccctcaataactcttttgaagaattgaataccgcaaaatgagcgtctctaaagaaataaaccacgatatcaatcttgatagagtcttggaagttctaacgagagttgccaaagaggcaggtgcaattatcaaaaagcgcaatggaactaccacttttgacaacaagaaaaactcagttgacctggttacggaagtggatcaacaagtagaagatttcatcaagaaggaacttttagaagagttcccagattttgagttcttcggtgaagaaagctttgttccaggttctcgtgtcccattgggccctaccttcatcgtagacccgattgatggaacactcaattttattcatgaatttccattctcctgtacttcactgggcttctccattaacagaaaaccaatggtaggagtcgtctacaatccccatttggacttacttttcaccggaattagaggtaaaggtgctttcttaaatggtgatcgcttgccatctctgaaaaataaaccattgacattgcaaagctcaattctggctcttgaaggaggctcggacagagaaggacataactttgaaaccaaacaatctacctataagagcttgttgagcaaaaaaggaggcatggttcatggttatagagcctatggatcagctgctatgaacctgtgttacatggccactggtgctatagatggatattgggagaatcataactcgtgggactgctgcgctgcttgggttcttttggaggaaactggcggtattgttattcacggtaataatggtaaatatggagaacccgtcgatgtggatgtcaattgctatttctacgttcgtggagctccagaagaagaccaaaaaaagtttattacatcatttcaggagcatatcactggtgaactgcaaggccctgaaatccattaatagaatagacggaattgatcttttactactatactacctaactactagtaaggaatccctagattacacaaaacgcttatgtaagacgccaccaaatagtaggccggtttcgcgcacattgccaacctttgcctaataaaccagtggcaagtaaatctggtacacaactgctcgcatcgtcatagtattcaatcatgggacaaggaccttcgggcatgccaccaggcggcggcaaagacaaagataaaaagaaacagaagccaaagtatgagccaccggttcaatcgaagtttggccgtaagaagcggaagggaccaagtgcttcagctaagcttcctaacgtgcatccctccactagatgtaagctgaaattgttgaagatggagagaataaaggaccatttgttgttggaggaggagtttgttacaaattctgaaaccttgcaacccacagaacaaaagcaagcggaagagagagaaaaggtagatgaaattagaggtactccaatgtcggccggaaccttggaagaaattatagatgatgaccatgcaattgtgtcctcatcatcgggacctgaatattacgtgtcaattctctcatttgtggataaagaattgttggaaccaggatgttctgttctattacaccacaaaactgtgtccatagtaggagtgttacaagatgacgatgatccaatggtcagtgtaatgaagttagataaatctcccacagaatcgtatgcagatattggaggattggagtcacagattcaagaaatcaaagaggcagtcgagttgcccctaacccaccctgaattgtatgaggaaatgggtatcaaacctccaaagggcgtgattttatatggagccccaggaaccggaaagaccttacttgccaaagctgttgccaatcaaactagtgctactttcctgcgtattgttggttcagaattgattcaaaaatacctgggagacggaccccgactttgtcgacaaattttcaagatcgcagccgatcatgctccctccattgtattcattgatgaaattgatgccattggtactaaaagatatgaatccacatctggcggagaaagagaaattcaaagaacgatgttagagctgttgaaccaactggacggtttcgacgatcgaggtgacgtcaaggttatcatggctaccaataaaattgaaacgctagaccctgccttaatcagaccaggtcgtattgaccgaaagatattgtttgagaatccagacccatctacgaagaagaagattttaacgattcacacaagtaagatgaacctagcggatgacgtgaagttggaggaaattgttacttccaaggacgacctttcgggggccgacatcaaagccatttgcaccgaagccggattgttggcacttagggagagacgtatgcaagtcattgctgaagacttcaaacaagccaaggagagagtgctcaagaacaagattgaagagaatctagaagggctatatttgtagatcaattcaagcgaaattttaatttttaaatagatcactcgtaggagcattgccttttttcgcgccccgctattcccaacgctttttttgtttcaaagcttcattcaccccacaatacacacgtacccgtctcgtcgaatgaacttggaaacggaagagaaaggaagcaaactatccaactttttgaggaggaaatccacctcttcagtctcctcttcgtcgtcgacaggatctcaaatagcaaggcgattgtccctaggagctcttggactggtttccgtgagttctaatgaagataagcacaaagaaaaagaaagcgccatcagtgaaagaagaccatccacagttacagtcaatccggtgtctaattaccgcttttcatttgaagtcggtatttgtgagaataagaatcgcaaaaaccgtcccacaatggaggatgttcatacatatgttgctaactttgctgagcggctagattggggctattttggtgtttttgatggtcatgctggtaaacaggctgccaaatggtgcggagccaactttcattcggttctggaaaagattgttatcaacaatgatacgatggatttgaggtgcagtctcaacaacgcatttctccaagcggactcgttgattcgtgacaagataagcggccacagtggtagcacggcagcagtggcagtgttgaggtgggaagaagaggttgatgaagacgacgacaagaaatctgctgatgatgtcgatgttcatcatccactgtttgattttgttccaacatcgagacataagaggatgctttacactgcaaatgtaggcgattcaaggttagtcttgtgtcggaagggtcatgcgctgcgactttcttatgatcataaaacctccgatattttagagcaacaaagaataacaaagaaaggaggcattatcatgaaaggaagggttaatggtatgcttgctgtaacaagatcattaggagactcatatatgaaagaatttgttattggaaatccctttacgacagcaactgaaatcaccaaaagtgatgaatttctgattattgcatgcgacggtctttgggatgtttgctcggaccagcaagctgtcaagctaatacgaaacatcaaagatccaaaagaagcttccaaaatgctagttgattacgcccttgcagagaacaccactgataatgtcactgtgatggtaattagattcgatccaagagtatttcttagtgatgattcaggttctgaaaacgaccaatcggagaagactcaggcaactactatagacgataagtcaaccacaaatgtacaaactatagcttgaaaccatacttcttatacgaaatatagttaatgttagtagccgccggttggctgttggccttttcaagagttgttcttccttctagcaacttaaccgacatttttcacagttcccccacagatatttacatccgaacaccgcatggtgtatttttgttttttggaacaatctgcacgaaccagcattaagcacaatcacctcaaagcagcatcaagcacaatcacctcaatcaaagtcatcagtcttaattaataataagaaataatggtataaatagacagaacttgccatctattctttttatcacaagatgcaacgattgactgttgaagtagaaaatgtacattgtcaccagtgccaagatctgatcgtggaaaccctctcagatctttttaccatgagagatggggaagtactggtgaatgaaattgaacatgaaccagaaaaacctctcgtatacttccatctgacagacaaccagttggtcttagtgaatgttgattcttcagtgtcgttggctaaattcgaacaccaaatttttaagagactgcagaatcaagggtttttagtaagcaagattttactcagtgacgcagacggtgaaacctggttcagaaacaccatatcaacgtttttccgcaacaaaaggagtatcaaagaaaagcataagcataactgtgagttttgtcacagtgataggactgcctcccctaatgactcggttgaaaaagtggtcagcacgagccaagagtatagggctgttttcaccgttggtggaatgacttgctcttcttgtgtcaacactgtttctgaagccgttaaaaagtttcttgtgcagcatggttcaccgattgttgatgaagaagggctgccgacatactctgtgtcaactatgaccaacacagccgtaataatcatttctcaaaaacagtatgtaaatgacctggtcaaagttataagagaggtaggatacgaagcttctgtggtggaagtcattccaattgagaaaattcaaagatacaaagtaactgcaagcataggtggaatcacttgtgctgcgtgcgcttcctctattacagaagctgtggataatttaccgaatgtggtagaatcttcggttaatgtggtaaccaaaacagggattttctttttagatgacggatctctccctgcaattgaagaactgaagcaggctgttgatgatgccggatacgatttcaataccatctcagttgaaaagacaaatcattcgtcagtaagatctccctccagaacagtctacttgcgaattgaaggaatgtactgcgaacactgtccagacagggttatgacattattgaaaacactgggtgatgtggtcctcgtcgaatcaccgttatcgttgcaggacccattggtaagaattagctacatcccgtctgctcaattgactattcgatcaattattcgaaagattgaagaatccaatgaaaaatttaaggtaacaattgacaagccattatctttagacgaacatctaagacgcttagctagatcagaattgattaatctttgttggcggttactcttgacaatattggttgcaattccaactttcattttaggtattgtgggaatgactttacttccctcgagccatcacttgaggcattggctaatggaaccgatttgggctggaaacgtatccagagttagttgggcactatttataatggcaactccagtgtacttttttgctgacgatatttttcatagaaaggcaatcaaagaaatacgaacattatggaaacctcatgttccatggaagcggagactcttcaaatttggttccatgagtctcctgatgtgtctaggtacttctgtggcctattttgcaagtattgctttattaattctttcagcacgtcaacacagagagagcaggggttatactaccacatattttgacagtgtggtgttcttgactctttttctcttaattggaagaattttggagagttattcaaagaatcgcacggccgatgctataacgaaattagggcaaatgaagcagtcatctgctttatttgtagacaagacggaagatggttcgttcggaccagactctactcttcctttggggatgctggaaaaaggagattacattcgtattcccgtgggtagctctcctcctttggactgtatcattgaagagggtgcttctgaatttgatgaaagtgcattgaccggtgagtctgctcccattaagcacgtgaaaggggatcaaatattctctggaacggttaacaaagggccttctgcaattattggaaaaatttcatctttggaagggacatctttgattgacaccatcattggtatggtgagagatggtcaattgcagagggcgcctatagaaaagttagcagatgcattgactggctattttgtgcctctaattgttgcattctcaatgaccacctggattgtttggatctcactcggaatgtctggtgcgttaccagatagttaccttgatattgatattggagggtggccagtctggtcccttcagtttgcaatagcggtatttgttatagcatgtccttgtggaattggtctagcagccccaacagcgttatttgtcggcgctggattggcagccaagtatggtatacttgcaagaggcggaggagctgctttccaagaaggtgcaaatattaacattatgtgctttgataagaccggaaccctaaccacaggaggtgaaccaaaagtgacagactatagtatattgtttggtactgacatgataaaacagatttttgaagtaactagagatatcgaattgacatcaggacatcctttagcaaaagctatcaaaacttttattgtggaagaatctcagagaaggaacttagaactcagtaataccatcgttgatgtcgtcgaggagatacctgggagaggacttcgtgggacaacaattgacggaaagaccgttctgattggaaatgagtttttgttagctgagaacgattgcgctaaacttacttcaaagcagcagatagcattggatgggtggaaaatgcagggaaagagcgtcgttttagttgcggttgatggattacctgctctattagttgccgcgagagatcctattagaccggaatcgaaacaggtaattagcactctgcaagaacgaggcataacatgttggatgataagtggagacaacgaaattaccgcaaaagcagtagctaaagaagtaggaattcccgaagctcatgtggtggctcaggttctcccgcaagaaaaggtttccaggatacaatggataaagaaaacttttgaagctaagaacaaagataagaaaaggtcctcagcaattataggaatgtgtggggacggaataaacgatgcacctgcattggcaaccgcagatgttggaattgctttggcgagcggatccgacttggccttaacttcggcagattttgttcttctcgcatccgcttatccacttactgctcttcttaggctcatcagtttatccaagacggtctttcgaagggttaaatttaattttggttgggctctagtttacaattgtattggaattccaatagctgccggagtcatatatccctatagaaattcaagattagatcctgtgtgggcagctgctgcgatggcattgagtagcatcagtgtggttctgagtagtttagccctgaaattctatcgtgcacctgaagtagttctagaggaaaaagaaactattgagggtgtcaaagaatggacgttgcgagaggaatgatgtcgcatttcggtgatagacaagagaaaaggtaaaagcaatagatgtgtgtgtaggtaaagtattggtatcataataatttcggagtaagtgcgatttttcagtcaaatccgacatcgcataggcatatgtcaaaatattcctttaatctaggagcttccactatcatgcaaattcataattatgacactgagaactcccagtaaacagggaaattctggcgtagaacctggcgacttgctgtaagctgttcaagcagaatttcacattaatgtaatatgataaaatgatacgttggacaaaattctcacccttttactgggtgattctcgaaggagtctcgagaaactatacccgccagcgcccgcaccccatctttctgaaaaattaccccgttgtcaacacttgctgaccaatgaaagtttggagaacctttctagataaagcttttcgtccaggtcaatagtaattttacaggattgagccatcattatcgtatcatccattaaatctccatctctagctaagattttctgcaccggacaccctctgtaccacccgcccgcccggtgtcagcataataatccttgtcatgattggtcctcccatctgcgtgcatgattggtcgcgaccgaccccggagtaggttgaagagggaattattaagcacatcaacttttctccttctccataccatcttcatcatctaccccatgctgtcagtccgtcgtcagcttatgagtggccgctcgtggttctcgaccaccagcgtagctcgcaaagtatactcagctcaacaagatgtcaaaggtaccaatgcttctattgccatggcaaaagattatcatatcatcgaccacgaatatgactgtgtagttgttggtgctggtggtgctggtctgagagcagcatttggtttggccaaggagggttttaaaacagcctgtatttccaagcttttccccaccagatctcatacagtcgctgcccaaggtggtatcaacgctgctttaggtaacatgcacaaagatgactggcattggcatatgtacgatacagtcaagggatccgactggttgggtgaccaagatgccatccattacatgacccgtgaggctccagattcgatcattgaattggaacactacggtgtccctttctctcgtactgaggagggaagaatctaccaacgtgcttttggtggacaatccaaagagtacggtaagggtggtcaggcctacagaacttgcgctgtcgcagacagaaccggtcacgctttgttgcacaccttgtatggtcagtctcttcgtcacaacacccacttctttattgagttctttgccatggatctattgatgcatgacggtaagtgtgtgggatgcattgcctacaaccaagaggatggtactattcaccgtttcaaagcacacaaaaccattatcgctactggaggttacggacgtgcctacttctcttgtacatctgctcacacttgtactggtgatggtttcggaatggtttctcgtgcaggtctgccattggaagacttggaattcattcaattccacccatctggtatctatggttctggatgtctgatcaccgaaggtgcccgtggtgagggtggtttcttggtcaattctgagggtgaacgtttcatggaacgttatgcccctactgctaaggatttggcttgtagagatgttgtttcgcgtgccattaccatggaaattaatgagggacgtggtgttggtccattgaaggaccacatgtatttacaattgtctcacttgcctgcctctgtgttacacgaacgtttgccaggtatttctgaaactgctcacatttttgctggtgtcgatgtcactaaggagcctatcccaattctgcctacagttcattacaacatgggtggtgttccaactaaatggagtggtgaagctcttaccctggatgaagatggaaatgataaagttgttgaaggtctactcgcctgtggtgaggctggatgtgcctctgtgcatggtgccaacagattgggtgccaactccttgctggatttggtcgtatttggccgtgctgttgcccatactattagagactgtttgactccaaacactcctcacaaagagctgcctgcagacattggtttcgaatcaattgctaatttggatcgtgtaagaactgctgatggtgatatctctactgctgatctgagattggagatgcaacgtactatgcagaagcatatctctgttttcagaactcaggatataatggacgaaggtgtcaagcaaatcaatgaaattgacaagaagtttgccaacatcaagacaacggacagatctatgatttggaactctgacttagtcgagactttggagcttcagaatcttttgacctgtgccacacagacagctaagtctgcttctgtccgtaaagaatctcgtggtgctcatgccagagacgatttcccagagagagacgatgagaactggatgaaacactccctgtcatggcagcacaagagcggttctcctgttgagcttaattacagaaacgttattactgagactttggatgaggctgagtgtaagccagttcccccaactgtccgtgcctactaagcttttgtaagacttagtcaattgaacttatttattattaccattacttttaaatagctccctgcaacattgtagatgtcgcgatgaatgagaaaattttcctcgaaaaaaaaaattcataaaaggaagaaaaaatctgtactaagctaagtagagttcatctgtattaaccaatggtttcaaaggaaaggattagtaaaaagagaactgcttctttcaagggggaggcctcaaagaagattaaaactcagaaagaggaatcttctcgtgaaagctctgctgaagaatctgatttgagtgctcaagctgaatcagatacttcatccgaagatgagttagacatctcttctgatgaggagacacaggacaagaacgctgacttaagcgccgatactgatagttcagaagatgagcttgatgatagttctgccgatgctgccgttgagaattcatccagatcatcagataatgatttagagaatgaggacggcgaatccgtatctgctgaccctaacaaactttccacgaaggaacaacatctgcaacagaaaaagctattaaatgaacgaaaacttcagagaaaggctggtatcgaagttcaccaaatcaagaaactgtgggagaaactgcgggttaagaacccccctttgcctaaggcagaacgtacagcattatgtgatcaagtgtgggacctcagtaagaatgtgatcaaagacttagttttgaagcatgacgcatccagagtagtccaaacactggtcaagtacagtgacagaccaagaagagataacattgtgaagcaattgaaaggttcctacttcaaattggctacctcggcctatggaaaatatcttctcatcaaattgctacattatggaagcaaagaaagcagagctttgattctgaaggagttgcacggaaaacttcgtaagttgatgggtcatagagaaggtgcttacgtggttgaagacttgttcgtcttgtatgctacggctaaacagcgccaagagatgattagagaattttggggagctgagtacgctgtgttccaggagcttggagctggaaagaccgtagtagaagtagctgctgaaaacactgaaaaaagaaaacagatcgctcaaaacttgatggaaactattactgcagccgttgaaaagggaagtgctggattccaattgttacacgcagttatgaaagagtacatacagatttttgagggtgaagaagtccgtgagatgatagcactattaactgagccatttgccgagctagtacacactcctgaaggctatgaggtagcctgtactctgattgccaaggccaatgcgaaggaaagaaaacaaatcattaaaacattgaaaggacatgccaccgagctcatcaataacgaatatggtaacattgttctgattgtcttgttcatgaccgttgacgataccgtccttgtgagcaaggtattcagcagtgaataccaagattcagtccatgaattggtggtagccaaattctccagaagaccgtttatctacctgttaaatggtttagactcacactacttttcacccatagtcaagacagagctattaaaatacgaagaattaagtgctgaaacatccaagaaatcccaagaactgagaagagaacagatcttgtctggttttgccccaatattctttgatgcagtaataaagcacccatttgagattcttgaagaaagccttgggtcccaatttgttggggaattacttttgaacccaattgaatctgataaacgtgaagctgccttaaacacagtgatcgagtcattcaaggggcctgtttcagatgatcatttgattcgcaaaccatttagtggtagattccttagatccttgattcaaggaggacgttggaacaataaggaaaaatgcatagataaagtggataatgtcggactcggtgaaacatttgctctcaactttgttgatgaagtatttacagatgacagaattctgcaacaatgggtaaactctgagggttcctttgccgtagtagctctatatgaagcccttaagcccttgaccaaagaagaagaaacagctaagacgttcgtcaaatctctgaaagcatgcaaattcgatgaggaagttaaaggagcaaagcttctgaaatcactattaaagtaaatataagagcctttaaattcattaataacaatattaactggtagtaagtaagctcatttaagctcatctcaattagacccaaacatctccagattattccgtatttttttttctcgatctgaaaatttgttctatcaacataccctcatgttccagttgtcggtgatatccgacctaatcagggttccaccacatttattccatcttccaacagacaaagctgttctaagtgaaatcaacattaagtatgcgaacaaggtgataccgaaactggggctttttgtctctgtctgggacttgatagagatccaagatggccttttgaagccaggtgatggagccacatttatcactgtaaaattccggggaatcatatggaaaccatttgtgggagaggtattgacggggtggattaaaaagaacacgccagaaggaatcaaggtcacaatggaattttttgaagacatattcatacccaaaagtctactctttgagaatgccgtttactcaggagatgaggatgcatggatatggaaaccagacgatgatacgagcttgtatctagatgaaaatgagaagatttactttagaatagaagaagaagtgttcacagacattaaacccaagggtcctgacaactccatgaatgttactgaagaaaaagagtccgaagaaaacaaggtaccgccgtacgctataatcgcaagttgtcagacagaaggaatgggatgtgttagttggtgggaataggaaattaagaatttcatatgtatttgtattatagaatgtgtcgtacgtatagtatcagttgtattgcatgtatctgcttgtggaactgaacttcatgtttcctttgattaccttctctacagcctgcaggaagtctttctccgtagccacctttcttcgggctctaatggcaaacataccggcttccgtacatactgatctaagctcagctccggtcgcattggggcaaagacgagaaattaactcccatctgatgtttctttcacatgacattgacttagaatgaatacggaaaatctgtgcacgtccttccaggtctggtaacgagaattcaacttttctgtcaattctaccaggtctcagaagagcaggatctaaagtattaggtctattggtggcaaacatcaccttgatattacctctgggatcaaatccgtccaattgtgtaatcaactccaacatagttctttgaacctcgttatcaccaccagctccatcgtcgaatctagctcctccaatggcatcaacttcatcaaaaaagatgatacatgcctttttggtcctggccatctcaaatagctctcttaccattctggcaccctcaccaacgtatttctgaaccagttctgaaccaatgactcttataaatgtggcatctgttctgttggcaactgctctagcacacaaagtttttcctgtaccaggaggcccatacagtaatataccttttggagggtcgatacccagcttgacgaacctctcaggagacaacaatggcaattcaaccacttcacgtagcttatcaatctgttctttgcaaccaccaacatctgaatacgtaacatctggtttctcctccacagtcatcatcgtcacagtagggtcgattcttggaggaagtggcaattggatttcatatttggtcctatccacaccgactctcatgccttcttcaatgtcagttggagacactctttctcctaatccaacaacaaacttggctatctgttttatattaatgacatattttgatttctcagtgggttcactgccttctccctcgccattgatgatcttcgtgcatcttgcaacttgcaaaggttgttcttccgacattctctgcttatcagctgtcacgtcccagagagtcgaattggataaacctgtgtcactttcttcaataccaatcttttctttaattctattctcgatatcgttcatatccttttcgattttcttcaactgagtggcgtatggagctgctccataggatttgagcacttgaatatcaccttcactcaatggagtaattttctcctcttgtttgtcctcatcttcaacaggagcctggtacttttcccagtctgcttttggtggcattgtgtactttaagtgagtgagtgctgttcctctggtagagagcgtgaaaggatgggaggcgaatcggttctgctggtagatgatgagattgagtcgcgcacgagctctacctataggataattaaagggtgtctatggtcattaggatgtggttaatatgtagtctatgaacaataaataagttgagtagtagtttctcaggactgataaatctgttgcagctgaatggtttgagggttacggtaagtcttgtaaagctttgacatgtttttcaaatttttggaaacgttagagtgcgaccactgtgaatcgtattgaaatttgggagcctctaatgacgtttcaattttgaaaccattggtgggtatctcttgtgccaattctgttcgaatgctagagacgtctagtgacttgtgttgtggtgatatgttaaacttttcgaccaatttgataatcgttaaaaattcttgatccagaaagatctcatcagaacgagctgagtcatgttgactgtcagtgatggtgatgggtaaaacttctagatgatcattaaaatcctttttgcatttatctagagccaagaatcgagtggtttgtgaaatgggcgcagatgaggacgaacaattgacttgaagtgaatccgaatcgcttgatgcgtcagataaatccaaagcaatctcatcattattgttaacttctgagttaaagtcatctgaggagacagaaacactcaattcgatttcgttttgattctttttagtcttcagtcccgtgacattttgtctcttgctagggaactgtttgtcttttccagaaagtgcaattgttcttttggttcctacatcactgacaaaacttgcctcatatcggacatgtagatgagcgctgaaccagtagtttggagctagaatctccaacagctttcttccggggggtgatccaagcaactctttttcaatatccgaacggaaaaaaggtttattttgcaacagcttacgcagatcgccataatgctctattccttggggccaatcgtgggttatcattatactacttctggcaatatttgactgtagagatagttttaagtagtctatccaccttgaatggtatacagatctcttttccctttcgttaaagggatacttttcattgtggggaaggtagaaatctctctctaaataaatacctgaccaccccatgatgcgaagtcctttaaaccacacgacaccagaggtccccatgtaatagatattaggagcgacgtacccaccatagggcaattcggtcaaatagttggaagcttcatggttgcctccgataaaaattgtcttcactggtgcctttttctctccggtataatactgatggaagtcccccagtctcttgtatttattggtgagcgaggcacaatccatgtcaattgtattcctgaaggcctggaagtcaccacaaattatcagtagatctggaagattatgcctacacttcatcttcaaacgctcatagatcttgtcaagctctccatgggcgcatccttggatggctactcgaagttcagtcatataagtaaaaaagtgaacagttggaatattataaattccctcgcttatataatagttcttacataactcgttcaggttattcaagaaagtctaaaacttgaacacatgagtcttgtcatatcctaaatcggcaagagcaccggtaacctcaccctggtcctgaggagaaactttctcaccagagatggccttatacaaaggaggtggaccacacacaaagacgtgactgtcattacttggacctggcaagtacttcttcaaaacgtccttggaaatgaaaccggaagaggcgcttggaacctgctcagcatccttgtccaagaaaagatgtagttcaaattgctcggggttcttggcggcagtctcctccaactcctttctcaaaaggatatcatttggagtcttgttaccatagaacaacttgaccttggtcttgtcctcagggttgttggtaatatgatgaatcaattgatacagaggggtaataccggaaccaccaccaatcaaggctatttccttgaactgatttggttgccatttccacttttgtagaggacccttgaaggcaagagtgtcgttgggtttcaggttgaaaatgtgattacccattttaccagtttcatatctcttgatgacaaactcaacaactcccttctcattgacgtcagagacaggggtgtatggtctaataacgttagagccctttggggttacaaacttggccaacaacagggaagcgacctccaagccactaacttggtccttttctggaagcttgaaatacactttctttgtgtcgtgagtgagatcctcagctttgatcaattgaaggtcaatccatttatcatctccaacgaaagcctttggggactcgttcgaggcaaagttcctggtggatagaaagtaggtcgagccaattgcagcggcagtggcagcaacagttgggataaagaaacgggatgatgaaattttagcaaacatattgggattctttagcataagtgagcaagagagttaaagtggagggagcccggttataaaccactcaatgctcgcacctttagcgaattactaataaagtagagaacttacgtattcagattcattggctgatgagatcgggtctttttaaagagggcaatcgaagggctcggaagtgacgggaatacacgccaattgtgtactaataggaattgtatccacaacgccaatcttgcactgttttaagaagttcggtttctccaattgactgttggatgtttcacaataagatcccttaaattgatctggatccctaccaacggattgtgctagcagggggtgctatcccccaaatcaaggaaaaagccgcgaagaccggtatggtatgttcttccttgccttgattcagtcttaccccagcaattgttcactgtaagaagcaacctaaaaagcaactaattaccctcatgctttctaaattggctaaaactgaactcatatccttggcaaaatcattcattccgcctctactaccgacttttcacaaaggtcaaacaggcaaggtagcaatcatcggtggatgcgaagactacactggagccccatttttttcagctcatgctgctgccactctgggcattgatcttactcatgtcgtttgcgaatacaatgctggaactgtgatcaagagctatagtcctaatctaatggttcatccgtatctgtacgaaactgacaatgttccatctcaattctccaataatcaggagagatttctgaaagataaggtattcccaaaaatatattcccttcttagtagaattgacgtcgcagtcttgggtcctggattcggaagaaaccctctgatgttgaagcaactggaatcgataattgataagctaaaggaaactaacaaattttttgtattagatgcagattcgttatggttggtgacgcagaaccctgatatcgttcgaaactatgaaaaggcaattctgacgccgaacgttgtggaattgagtcggctttgtaaaaaattgaacattgattttgacattaccaagaacctgactttagaagaaagcttggagatagccaagaagcttagtaaagagttaaacgttgccgttattgtgaaaggacacgatgatttgataataaacagagacgatcatatcgtttccagttctgagggttctctaaaacgtgttggtgggcaaggtgattcactttcaggtttaataggaggtttcttggcttgggctaatgcttatcagaactcactatggaaagtgcaagatgatccaaaattgactaccagtcaactgattcttctttcggcatttgcaggatctctacttactagaacatctgcccataaggcattcgacttgaaacaaagatcaatgcaaactacagatcttcacgaccacatcgctaaatcattcacagaaatatttgagagttagcaattaaatattaatttaccatgaatcacctcttctaaaggttacaccaatgtatcttgccaatgtatcaaataactcatccaattctttttttgagaaatcgctcgatgacacgtcaacttggagagttggtacgtcaacactgccatcgataaattcctggtattggttcttttcagcactagtaagaggtagcaggtcgtagaatctcaacagctctattagcaaatcgtcatcaatctctgaaaattgcttgagagtagttggaaagtctaatagctcttctccatcgttgttgcgtaaaggcgctaattttctttcactatcaagagttatggtagagttagccgttcttctgattgccctctcttccacaatgtcaagttgaccttgaagctcaccaaccagctgaataatgtcgtcgtttgtagtataatccgaaagatcaatttcagcgttgggggtaggtagttcctgcaacttccttctagtgtcttcgacctgatattcaagaagctgttgagtggttttctggagaactttcttttgtttcaacacgtcttcttggaggattttaagttgatctttgagctgctgcagttcagacattatgttttgttacaaagagaagaaactgatggcgagaagagctacgcatagctattgatcgttaggttcgagatttggtgacgtcgtaagacggggctgtgaaaatagttgatagaacaccgttttggcttatctagttaaatgttgtatagagaaacactttgatgaagcaacgttgaagaccttgtccttcaaacttcaacagctcagactgttatgcagctaattcctctctatacagtgtgttcgtccttctggccatcagtcgctcgtactcgaattttattcatcatttataatattctccaccttaaaacattcaaccatgggaaatgaattcacaaccgtgattcaggtctccaaacagtttctctcttcggaggaaatcaagcagtcacaagaatcgtcgcttatgaaagatcagcagtaccaaaattatgtttcaaaaaaacaggaagtgatgaggtttctcagatttttaatcattcggctgaaattccccatcagagttctccaagtcacatcatatctttttcagaggttctttctattcaactcatttcgaaaatactcctcctatagccacgagattgcagttacatgtctgtttctgagcatcaaaatgaacgattgtatccggaaatccagagacttaatactggtggctcacgatatacggttatcacctcctttgaatagcgatgaggttgtcaaagatgaatcagatttgactcatattcttgctgaaaacaaagtggacgagcaaaggaaaaaagtcctttattttgaaaggcttatcttggaatgcattgcatttgattttagacacaacaacatcgaagattacctgatcaaattttcgaaaacgctctcattgcatccacaggtggggtatatcagttggctagtatctgttgatgccatgatgactgaagtgatcttaaaacagtccccgcacgttatcgccctgtcgagtatagtcctggcaaagcttctctacccagagatattcacagataaaatggttataactgagcttgactctttggatctaaaatactctaggtttcaatgtgagaggtcacaaatatatgaatctgtcaacgaaatgatggagttttacatgagtaagaaccaacttgcaaactctttcctgtttgattttttgcccaaagatttgaagttcaacgatctggtcatcaatcttaagttggagcttcctaaccattttgatattccaccgaataagcggaaagcagaggctacgattaacaaggacgacttgttttacaaagagagggattacgaaataggaaaagctggaaccatactatttgtgtacaataacgattaactttaatattaaacatgctgattcatcattttttgaacgtagctgatggactttaaacaccatgcatttggttttcccgaatcttcaatttcagactcgttcaattctttgatatctctcaactgatcattaagaatcgagtttcttttatcttggggcaaatctttaaggaaaaacggtgataatagccatcttagataaacccagactgcagaatcgtccgggtccgtgtagtatgcattttgcaaaaatgataattctttgaccaggaatgaatacttgtcttcaaatccttcagttttggagttcaggagcttttgaagcaattgacttctattatgccaagcagaataattggagatgttttcttctattagtttagtggtatagttgaactcctctctgttggataaaattatgtcctcttcatgctccatcttgtcttgtacgagaccaacaacgtaccttctataagcccacacatgatagtttcttgaatccatggttagcattttgtcaatcagtgccatttcctgctttagatcaaacaagtcatcctgttctatcagccattttctatgattccaaatccaataaactttcgggtaggacttgagttgctttccaacaaactgtagctctttcaatatgaacgtatgagcagcttgagagtctttgagattactgaaaacatgatttgtgatgatatcccttctatagttccagacagtgtaaaactctgggttcagatctaaaagtcggcttgtttcgtccaaagtatcgttattgaagatgtttttttgtttatctgcaaggacactgtctgtcaattgcctgtagtgtgaaattttgaaggcatctctttccttcttccgctgtttggcgtctttggataactgttctcttttaactccgtgcatcgatttggagggtggagtagggaaagtagacggcgagcattatttccgcttaggctctgctcgggttgggtacgagagtttaaggggataaagagagcaactgattaaaatagttagcaagccaatgtaacagtaactgcagtctaaaggaagatgaatgcttctgataaggattctagaaggccaagtagctaccaagtaagataaaatgagttccttgatgtgcttcagagaagacaagagttcaacttgacgtcgtttctctggcaattcactcaattatacattccaattctcgtatatactagacctgcggagtaatataagaattagcctgatggtgatgatacagctccccccactttctcttatcccccttactatgtatggtcctgtgtctcaagtgaacctcatcgctaaaataaaaaatgaaaaatataatcttaaaaaaaaaaaactagatctaaactctaacatactatggctaaagaacgaggaagaagaaacctgaaaaagatcaaggaatcctcgcagtctgatagcctcaagaccttgaaggcggatccttcaccctcaagagaagctgctcaaatagatgtcaacaccttttttgggctagtcaactccgaagagcttgattatttcaaacaagcagaatccacccttaacgccaatgcctttgaaaatagcgaggagaggcagggttttgtttccagcgtttttgaagaagcaaagggaaaagaactgaaattagtgaccaaccaaatctgctccaagttgatggagaggttaatcttgaatggctcggacagacaagttaaaaggttattcaaggctttcaacggtcattttttgtcattagctgttcataaatactcatctcacgttttggaaactctattcatcagatctgcctccgtaatcgaaaacgaattgttgaacaactatcaggaggaagaagctgaggaggaagaaagcgatgaagtatttgcaactatggaaaatatgttccttttcatgttagccgagctcagttcatccattcaaaaattaattgtccatcaatacggatcacatgttatcagactcttattgttaatagttggtgccagagaacttccctcgtcaattatgagtaactccatcttgagatccaaaaagtcaaagatagcaaggaaaatgattgaaattaaagataaccaagattctaatagagcataccaagttccagcaggattcaagaacgagttacaagaattgcttggccttatagccaaggacaaagattccaaacaactgagagagctagctatagacaagatagcttctcctgtgattcaattatgtattcagttagaaggtttggttgacaaagatagaaccatttggactacaatctttcctgaagttgatgacaaagatccaaaggaagaagctttcgttgagtaccttttatcagacccgatagggtctcacttcttccaagcagccataaaatatcaaaaaccaaaaactgttcatcgcttatatgacctctacataaaggatcgcctgttaaagttagcaaaaagagaaacaaccggtgcatttgtggtcaaggaactgctgggcaaattgaaagccactgatgtgacagaaatgttagacattcttatccctcatttgagtgagttgattgaaaataacttagaaattggccaagccattgtagatgcttccatcgctaggaacaactacggtaaagagggcattatctcccaatttctcaaagtattcaatgatgccaatgtattggagagtgttcttaaactttccacttcaacacttggaaacaccaagaatgattggcccactgcagaagagagacgatgtgcaatttttctagaaaagttggtggaatatgacgatagtttcctcgatgcagtcattgctgcattgttggagcttccagaggataggttcattcagatgtgcatgcatggtgtgttttcacatgttgtagagagtgttttagtgattgaaagagtcgacattgtcaagcgaagaagattactaaacattttcactgagcatgtagtcacactgtcttgcaatgcttatggatcacacattatggacaaattatggcaattctccatcaagttgaatctcttcaaagacagaattgcactggctctgtttgaaaacaaagacaaaatcaaggacagcatctatggaaaacttgtttggaagaactggtctatggagttatattgccgaagaatgtatgactggaaaaatcttataaaacagcaggagttggagcttttccccgatcatagaggagctccaactctcttgaagaaaaggcccctagaagagccgaagaaagtagaagagaagaaggacaaaagtagaggacgtagaagatatcattagaagtaaattaatatataattgttattataattgtgcttttttatagggtcctttgaagtaatgggcgagctctattgtacccaaaatctggggatgaaccaaattacacgtaaaacctatacaacttttaatttctatttccaaccaaaaatgtcatatttgacggcaacacgttcaagtcaccacaagaaagtctcctagagtgtaatacacctttagtattttaataatataatggccaataataaaagcctaatacctatcactaatctcacgacactgaggacgtcgcttttcccgatatggaaatgtcagagatcccgcctcagtttaaaatgatgaaaaaaaaaaatatccaatttgaacccaccacccaaccaacctgaaaatgtcaaaagtcactgtttcgggttcagagatcctagaagggtccaccaagaccgtcagacgttcaggaaacgttgcttctttcaagcaacagaaaactgccatcgatacgtttggtaatgttttcaaagtgccagattacaccatcaaagatatcctagacgccattccaaaacactgctatgaaagatctttggtcaagtcgatgtcctacgtcgtcagggatattgttgctatttctgctattgcctacgtgggcctaacttacatccctctgctgccaaacgagtttcttcgttttgctgcttggagtgcgtatgtgttcagtatttcttgttttggattcggaatttggattcttggacacgaatgcggtcactctgccttcagcaactatggctgggttaacgacacggtcggctgggttcttcattccctggtaatggttccatatttttcttggaagttctcccatgccaagcaccacaaggcaacaggtcatatgaccagagacatggtctttgttccatacaccgctgaggagttcaaggaaaaacaccaagttactagtctgcacgatattgcagaggaaactcctatttattcagtttttgcccttttgtttcaacagctcggaggactcagtttgtatcttgccacgaatgctactggtcaaccgtatcccggggtgtccaagttcttcaaaagtcattactggccatcctctcctgtttttgataagaaggactattggtacattgttctgagtgacctgggaatcttggcaaccctgactagtgtttacactgcttacaaagtgttcggattttggcccacattcattacttggttttgcccttggattttggtcaaccactggctggtatttgtcaccttcctacaacacacagactcgtccatgcctcactacgatgcccaagaatggactttcgccaaaggtgccgccgccacaattgatagagaatttggtatcttaggaattatatttcacgacattatcgaaactcacgttttgcaccactatgttagtagaattccattctaccatgctagagaggctactgagtgcattaagaaggttatgggcgaacattaccgtcacactgacgagaacatgtgggtcagtctctggaagacctggaggtcgtgccagtttgttgagaaccatgatggtgtgtacatgttcagaaactgcaacaatgttggtgttaaacctaaggatacctaattagagtgcttatttatgtattttgctttctacttcacattttatagaatagagatagtttgttttcatggtaaccggaactcttacaagactccagttctattactatttacagcgattcatgatgaactaattgaacctcaaattaatcgactgatctttggtaagatcgacaacagtaccatcctgcatggtcaatgtccaatctctgatctcgaaggcgtgatgtctactgtctctattggccacaagtctcattacaccttcagatttatctccactgacgtttacagtgaaattgatatctcccttcattgtgttcaaaggtcctttaacccagggaaatataccagcaaaagtgatctcctttccaattaaatccctggctacttgcgaccttctcaaaaaatacatcgtggaattcatgattggagacgatactttttcatagttgaaaattccaaacaacgatgttcccattacaacaacaaatgcaatgaagtatatcttgtttctgcgaggctctttcaaaggatctgggagctcatgctggacggtcatcggctttttaccacttttgtcgagaatcaattcatctgctttatgttggttcatgatcactttaacggttccaaaagttcgtttagaagccatccatttgctggcataagtgaatggagaaggcttcagttttctaagggggccaagtataagcatttctctaggctggtatgttggagcagttggggcttgaaatttgaaagtaatagaaagctaccaagacatttcaaaagagggctcgaaatagcttatatctccccatctctttttcatcattgcctagcaaagacctgtaacaggctccaccatgtcaaacgtctccggagctgcatcccataagaagaaaaatggaatgcttacagtcttggaggatcaggagccttcgatccttcaatggtccgccattgatccctctgtggcagttcctttggtgaaaattcgcttagattttatcacaagtttgagagctaccaatcccaattctaaccaaatgatgatcaaagtactatacaaggactcttctggcgcagatgaaaagactgcattgttttcatttacaaacagaagtgttatggacaacatacagcgtacgcttcagcaggtagtggcaaggaagaaggcatcgtcttccactccaggcgccactacaactaaggacactgatgcagcctcatccgctgcaaccccaagtagtcaggttaactctaccgataaggaggacctgtctacgtttcttgattcggacaagttactgaaagatcacaagctacaacagaaattactcgttgacaacaagacgctaatgattacgttcaaagaagctgtgatgtctaatggattagacccagaggagttttggaagactcgattgcatcttctaagatcatatgccgttcaacaagctcaaaaaaggggaccctataatgttcttagtaccatcaaacctgtggcaagtagtgacaataaagtgaatgttacggtaacaagagagaaaatccagtcaatttttgaacagtaccctatagtgaggaaagcctatgatgaaaatgtcccccgattaaacgaaggtgagttttggtccagatttttttcgtcccgcctatttcgacaattgagaggtgaacctaccagcagctatgatagggctgatgtagttctggacaaatatctgtacatggaccctaatgccgacgagcacacaactaaagaaagcatagaacacattaatcctctgattgatgttcaatctaatgaacaggataattcagtcaagcttggaaatgctccagatgtgacaatgaaagtaaacaatgataacagaatctctggtataatgaaaaacatgaaccgtctttctcgcaggatgttagccaatattaaagacgagaatcaagataaaactccggaggttgagcaattagaggaacaactcgaccttagagacctagaagatgatgtggagctggaatataatgaactgaaactccagaattcaaaattggtacagaacaaagccaaccgtattgatgatcgtatttcaggcgattataccgaaagtataaagacgtcacaacgtcaatttcatgaaccatttaacttgacagatatctataaccctactacacaacgacaagcaatatttgatgttgccaaagaaatatctcaaatagtaaagcaaaacaccaaacaatattcccaaggctggcaagcagctaacttgaactttcaagattcaaaaacttccacaataaatgatgttggcccagaaagcttgaacatttcaacagatgagttggaggagttaagacttacacatatgacctccatcgagtttctaagacatttttggtcgcatttgggaagcggtagcaaagacaagcaggatctgctgacccttaaaaaacttcatgcttcagtatcaaagtgtatatctcgagttgaagcagtggtagacaaatttcaagattcaaattctaagcagacagttcatgcaatcatgcagccattggtaattagcttgaataaagcgttagcggagtatcaaaaagcaagttcggcaatgctagaataccaagagagagtgcataaatcaaggactcaaacgcccgtttagaaaattatttattatttactgaatgttattactctccttaaacttatcccatgcttgattcaagacgacaaaaacgttctgcgcaattagtttctgctctgtggtcacattacttggaattttatctggatgagttctagcacatgctttcatatatgtaagtttcacctttttggtaagcaccagatctgacatggacacttccttccagttcgactctgaccatagtatggtgtgcaaggaagacagaagagcacgtaaattatcttctttaccattcttccatgcattaactttggcttctacagcgtcacgaaggacaaatttttccttttcctctttctcactctctaagctttgttgctttagtctattgatggcatgagatgatttgtagtttgctttataagtcgaaggagaaggggacggacttggagcaggtctcgaagttcgtcttgatgctggtttcggattcaaaatgttcaaacaccttcgtttaccatccaggatatctttggatgtttctccattagttacaagtaagttatagttgttcaatgcttcgttgaatttctccagatgttccaacgcttcggctttcttcgtgaccagtttgatccagaatgctttgatgggtttgtcatagtctttcaatttcagctgattgagattactaatagaaaagttatcaaggctttctattattgtcaaccccgatttacaattggaaagtgtctccttataatcacccagtttgaaatggcaaatagcaagatttgaatatgcaacaattgagagaggatgattgcttggtaattgcttaagtgattcttgatactttatcagggcgttagggaagtctccatttttgaaaagcgcatttcctgaagatttgctctcattaaaggagtcaagctggatagatccaatattagcatcaattatggaggaggagtcttgtgttgggccggttgaacttaccgacgtactaaatatatctaacagtatctcattacgaggagattggtcggagctattagtggatgatttagaagatgctgggcgttccttatttgtcgcatgaaggtttcgttgtctctgcctgtttctagaaggaagttcatcatcaaacttgaatctggatgctggtgttttcgtttctacggccctttttggcggagctgttacattgctcggtactcgaggaggcgtagggttttcatcctcaatgtctatggaccgtgccgagtacttgtgatgattcttcatccatgctggctggcctgtgttctttgcaaattgcttctctttgtaattttctacggactttgcaaccacatttcttcccttttcaaacaacaatgaggctttcgacatgaattgagttgatagctcattaacggcagtagagaaatcttcaggctgttgatggagacggtgggtgttggcgtcagcctttgacattatgtaatctatggcctcattcaaatcaccattttttgtgtgatccaatgcattattagcttcatctacagagaatcccatataaactaattctgcaagtgattgatctctaactattgaaggggcagaactggactgagaccgatttgaagagttagtatgtgtcggttgatcaagattggagacgctgccattcttcaattcttttttagactgctctgaaggctgaggtgtcatgttcacaggttgaataggtgcactattgaagatatcaaacacatcatctatggattgtcgactgggatttttggtgacattgttcgaaagtgtagttgaaggtacgggatttggttgaaaaacactggagccgctcacattgggtgaactattgaccggctccggtaccagaggagttgacacttgactggataccgtagagtctagcaaatctaatcctgaccaattgtttccaagtgagggttgaggtgttgactgcctggattgaatctcggacaatgatgctaacttgttggaactcctggtttttcctgaggctgagctcaataaatcagcaaacacatcattcttttttgacatctcaccgatcttgtgagtgtttaggtctgaaatagcaggcagttgacggaaatctatgcaaaagataacggtccagttattaccaaaaatggaaatactatatattacctaggacattttcacttctcaaagtaaagaaaattttttttctacaaggaacaccacacttatatacaaaatgcatttgatgtacactattggacctgatggaaagaggatctacactttggaaaaggtgaccaaagagggagaaatcaccaaatctgcccaccctgccagattttctccagatgacaaatattccagacagagagtgactttgaaaaagagatacaacatgttacctacccagcaggaagaataaattctgagacaataattggaattgaaaggggttcagagagttactgattggcagagatgaacgttaacaacgatcattatccgtcaataggttgattaagcacagagatcgcataccatgaattaaccactagaagaaacatacgattaatagtttgtattataataaggattgggtattttcagctattctgtgttggtgttgtgttttcacggtcataaacttggttaactgtagcgtggatacggtgctaaagagaacatcaatatcctcttatacaggattttctagagatgacgttgcttccaatagatagtttgaattcttgatgtaactttcccacatttgggctaatagctcgatatccaaattgctcttgttgatctcttctagagccttgttaatgatgacaatggattcattcatgcgttcctaggggttcatgttagtacccaagccgggagtgtttcgtaaagttttgaatagatgcggtaacgtaccatattattgataattcgggcgtgcaaagcgttttgcacttgctcatgtggattctccatggagtatttgtaatgttgaatagttgaatagcccgcgttggtatatttatgctggtgtttacttatttgaattgagtcgagaggattcttcgaggggtctcagattccatcttcatctcaatgaaaaaccccagtcttaatgcttaatatcgccactttgctggtattttcctttctaatggggatttcgtatgtacccgtgtctagtttgagttattaggggacaattgggatttactaactactaaaactcagctcattcggctcaggtttgctcccgttatatctgaatctcaatgagatgcacatctccttggtatcagctctaggaaccgggattatcatctcttctgcgttgaccatagttttagaagagggactgagcactcttcaaagctcaggctctgatctttccatgtttggtccttacattctatttggattcattgctatgtaccttttcgacaacctcggaaaagcctttagatatcaaaacctgagtttagacacgggaattcaggacagggacgttaacgaacacatttacccagagtcatcccaatggtccaatttattcacatctgtcctccgcacttctaccactttaggcctttgcatacattcactgactgatggtatcgcccttgcgtcttcgatattgactaggaatatgagaataggtgtgataatatttttcatcgttgcaattcataaattaccttcggcctttgccttgacctccattcttttgagagaaggactgcccaaggatcttatatacaagcatgttggattattctctctttctgcaccttcaggggccatattgacctatatcatagcgagattactcaacctctctgatttaccatattacacaggagcgttgcttttattcagcggcggaacattcctctacgtagggttccactcattaatgactatcacagacaatagagggaggatttcaaaattagaacttggtctaagtatattaggaatggttctaccgttggtatttagccttctaagagaataaagaacaatacacacatctgcatttactttaactacctcttatctagactttttcggttaagccactcatttcgtcgatcatgcaatttagattttggaactgaaactctcttaagcagtttaacagtaactggacctttatttatgcagagtttctgaactctttttaaactcttaggcttcaacaaatcatcaggaaactcggtgcgatctccaaaatttatatgtgcctttttagtttgagaatcctggaatgtcggttgcgttttttctaaggattctagtaattcttctggcaaaagttcatcaacattctcatcaactttaccatttttccttttttcgtcttgctgtttctggaatctttcattcagttgtcgtctcttttgctttagcttttctgcctgctccttttccatctgttttcttagtaattctatctttgttacattttcctttgcctgggaaatattctcctcctctggagcttcgtcactatcactcccactcccatcttcagccacgttctgttcaacatctggttttatgtcttcggtgtcttgtggcacagccttgaactcatcttcttccccaaatttgatcttcataccaaaagcaaagatgtcttagtctgcagaaattgactagtagaattttttttttttggctttcacgaagatgagaaacatcgcgatgagtccaaacagtaaatagccatacactataaggactaactaatacatcaggagagcgtcaatgtcaatctcttccaagtctccctcatccttgacaaacatctcgtccgtaactcttttctttccgttacttttagcttcttcggttatcaacttgttgtccaagactgtagccaagcttttggatattttgttgtacctttcttcgtcaatttgcttcaggtcaacaaccaacttatcctttgactccacaagttggtcaaatgacgatttgataactttgtctaccttttttgggtcgttcaaaatagctttgcccaaagattctccctcctcctggttctttatgttgaactcgttaacaatatctctcaatatcttgttgaatatatgaatggaaggtgatctgctgtgtaagattttgttccaagtattatctaattttgattcaacattcggtaatggcaacggcaaattggaatcaaaatcatgggtttcgaaacatgctatagctggtttctccgtcttgggatcatcaatattcatcaaatcaacaaactcgtccatctgatccagcatcgcttcggacggcaaataatcatcattctctttgactccaatgagattaaacaagaatggaagtttttgatcttccttgaaaggaagcatatgcaaggccataccatatacattctggttcttcgtttcatcaaattctcttttcaatccatcaggacctttgtccagggtaatatgagcattcactaagaacgggatcaacgcacccataaacactccagaggagcttctcagagtatacctgataataccaacactgtcaacatctaagagagattggcacatggcagcaaaagccacccgatcccgtgtagcttctccgccaataagtaaagttggctctcccatgaaaaaaaaaagatggtaatctatccttcttcacgaaacctcgtatatcgataccagaatatgtaggatatttcaagagttcgttgaaagtgctcgtgagcgggatcaaactagttccataccgataagttttcattaatgattcattatcaaccggtatctcctcatacttgatctcgatgtcatctgtatcctccttctcctccctgtcgtcctctttctttgtatcgatttcctcatctgctggtgtaattctttgtttgacaatacggtctcgtaaaagttttaccgatttaggctcttcatccgatgcatatcccatgtgcttcgcagaaggcttcttctcttctttaatcaatggatatccttcaacattaatcactaacgaaattggatctgtgtgtcgattatattcccgatcgttagaaaaacttgcattctctaaatctatgctatcaagatcacaacacaatcttaattctccattaaaggtcctggttggtttgtaaatcttaggaataccctttttccaatctctcaacagatccagagccttgtcaatgttgatggtggcagattggcttggtttgtcattagacttagacttaattttcaagatcagttcattccatttaaaaaggttttttctttcaaatcggcaattgtttcatcatattttttcccctttggatccaaatcaatgatagtaagtctacagttaaggtcaacggccaagacacttaatccctcaattaaagatatttccagttcattattagccgtatggtttgtaaacacgatcatgttgcattttcccactgatgcctttgtgcttgtctttttggctccagatttggtagcccgtaccaactcctcaaatgccagcaacagagtttcagaaagcgatccgtcttcaatcaagcctttctcatcatactctaaaggctcatgattaacatgaagcgttgagtccagatcctgaatcaactgatatgacggcatggagaaggaagtatggatcctgcctcgtttgggtttcacttggataagctcatcatgacaggtaattatgctaacttggtcgttttttttccctctaacaactttgctcaacagaattcccttgatgtactcaattgctttgtctagatttttcaccaagggagactcatctactacaaacaatgtccattccttatccattgtggggtgcctggagaattgagtaggtatggatgccagttgtctagagacagatgacctcgcgccaaaatatctcttctcaggtaaacgacacgacttggtgctttctctttgagccagacctaccccttatgaagaaatgatggaccaactccaggctcttagggtggaaataaaggattgggagtaccaatttttcaaaactaaaggctggaaacctttggcggaggatatcaagcaaaatgcagagattcgacagaaatataaagaatacaatcgatataaacgccaacagcaggcgaatgttacaccaagaaaggaaaagaaggtatctggtggagctcagacaacaccacagaaacagtccttggaaaaagaggtagccacacccagagatctgggaccaactcctcaagtatctggtagagtattgagcatttttgatatttcaccagtcaagagatctgccactggggaggtattcagaacaccctccaaaagaaaaagacctaattcgaatgaatcacctttgaaattaacaacaccccgaaaaacacccattgcaagggggccggttctctccgagacgccgttgtacctgaggcaacagagttttagtatccaggaagaattgatggcggcctcgcctaaggtagttcaatcagagtctccattaaaggtgaacttgtcatcgcaggaaactccaacgaagatcacagaaacttttatcgaaccttcacctgtttttgatccagtcaaactggtcaagagaaaatcgttatatgaaatgtcaaaggatttagaggcattgcagaatgagaagctctcaatcgacggagtagatgaggactgtttggatgaagaagtcctcaagctgatgcaaggggagacaggacctgacgaagaggagttcgagaacgggatagataaggaaacgcagttacaaccacaggaagaacctctgcatagaaagaaagccactcaaaagagaactactaggcgggccaagataaaagttcgaaaataccatgaaaaggacgaagagcttgatattgaagatattaccaaaaaaacggacgaatctatccgacaggatcttgttaagcaaactggagctcaagaattagaaacagaatcggaaacaaatgacgatgacgacgacgataaaggtaacaaaaacacaattttcaatccccctcctggtggctatagaaagacacgaaccaatttggtgtccaccaactttgtcaagtacaagctaaaaagaaaaggtaagagaagaagatgaaaatcgaaggttctcaagttctacacagattagtgatagcatttgctgtaaggtaacagaataaagctctcagaacgtacatcaacagcccatagtttccagtgtaatatagaacgaaagacgttaaaaggaaagcaccgactgagaggctacttaacaatttcttgtgctccgaacaaaattgcacaaaccagttgggacccgaacaatccactagggagtcggcttcctcatcgactgagtgtggagatcttgatctccataatccccatctttttctaactcttccgtaaccaggattttcattgacaatagaagaatcattatcctcctgacttccagatacatctggggccggaactagtattgattcgtaattcaatggagttttgatgttgacggagttatgagaaacttcactagcaactctggagttggcatcagatacgaggggagactcagcagttagaccgataaaatttgactgttgagggatgtttgagtttgcaggaagtggttttagccaatgtctagatgggaagctacttattgttgattcagttgtggatcctacagtggacgcaatgggaggtcttgcatcagtgacagtgtgtgatgcctggggctcattcttgctagatttcttcctttgggcgctgccagaagttccaggtctgctattggggactactttcatcaaaattttcataaccatttgatttcaagtatagaatatggtaaataatatctggagattaagaatttggtttgtgatacatgagttagggatagtatcgttctagtgttgttcgcggcgtacctgtcgcagtgtctttcgcaggagcatatggtgttggtagataaatagttcgcatcaagtgacacttaacaacaacacgtccctgctcaatgttgctcttctaaggtgccgtgtaacccccatcaacacgaatatcggcaccagttgtgtaggaagatgcgtcactggcaagataaatgtaggcacccactagttcttgtggaagaccctctcttccctgagggataatggaccaccatttttgacgaagttcgacgtcagcaaacttggtcaattcagtttttatgtagcctggagatactgtattcactctggcaaactcagaccattcaacagccaaagatttggagaattgtaatacagcggctttggctgcattgtagggtgcctgcaattgaggatagttgacaacatgaccagacattgatgctgtaattatgaaagaaccctttttatgttctctgaaatattgtccgatgacctttgcgcaatagaacacggcatcgacatccaacttgaaaactttctcccattctgcaattgcttcctcatgaggtaaatccaagattgctcccgagctccaagccactccggcattggcgacaaaaacatcaatttttccgaaatcttcaatctgctgttctatggttgatttgacagcagagaaatccccaactgaacacttgtaggctctacacctaacaccatacttggtggagatttccttcactttttcagctactggtgtcgagttataccaaatggccacatcagcccctgcctgagcgtaagcttcggcaacagcaagcccgattccagcggatgaaccagtgattgaggctacttttcccttcaaagaaaacaacgacagagcatcgacattcacatgatgtgggtcagacaatggcaatgttactccgctgtcggagaatacgctcgtaactttattttcgggcatttttttgtatatcctagtgcttaactgcctagacgcaagcagggttattgggctccttatataagaggctcttacatactggagcaacgaaaacgaataagcccggtgcattcgagaaagtttcggtggttttccgaggctgaaatttttcattatctatgacgttaaagttcgggtaagccctttgatttatacacttttggagagtttaaggggagaaaaaaaaactgcgatatgcaggatacttgtgttggaggagagccgaaagtattatgagcacagggcacgaacgtgttctcctaggaatcaggccaagtagtcagtaaccgtttagtcagtaaagttcggtttttctagtttatccatccatatttagcatctattcagggaacaaatcttgaataatgtccaacaactgcatcgattctttcttggagcgtctaagagttcgttgttagggaagattaagcggagtccgtctcgcttttctcaatagcctacacgacggagtaaccaccatccactaccaaattggtgcctgtggtgtaagtggaggcattactggccaagtagaggtaagcactagcgatttcctctgggaacgcttccctacccatggggatcaaagaccaccatctacttctgatttctaccggtaagaagtccgataatccagtatccagatatcccggagaaatcgagttgacgcgtgcgttgaactcggtgaactccacagccagcgattttgccaaatgtatacaggcagatttggcggcattgtatggagcctgataatttggaacgttgacaatcgagccagacatagatgctgtgatgatcaatgatccgctgttgttggctttgaataccttgccgatgttcttgcaacaatagtaaacaccgttcaagtccacgttcatgacacggtgccagttcttgtcatcttggttctcagagttgagaatagatcctgactgccatgctacaccggcattggcgacaaaaatgtcgattttgccgttgaactgctgggaaattttgtctattgcctcttcgacattcttggagttgctgacatcgcatccaacgcttaaacacttcaccccgtacttctcagagatctctttggcagcttctgttgggttttcataatcccaaagaatgatggttgctcccacggatgcgtaacattctgcaatagctctgcctaaacctctgccagatccagtgatgaccgccacctgtccatcaagacggaacaacttcgaagcgtcaaatttggtggctctaatgtcgttgatgacatcaggagccggttgaggcaacggtttaacagagttggtgacgtaagaggtagcaaggtgggcgtttgtcattttgggtaagggaaagggaaggagggagacaactcaatttatttatataattggagaatgtacatgttaatttgaaataatggagtacataaaaaaaggaacgggattttttccgagaaagcttgaatgacatggcattgttttgctgatatctaatattaattttttggttaaagtctccagaaatgaaaagaaaaagaaaagagaagggtgctttttgcatggtgcaccgtggtaaaatttcagcatccaattcgatcctattccagaggcatttggtggtaattctggttgacaaaatcatttaggacataattcctgattagccctatataaacgtgcataataaactgcgggttttaaagttgttccattgggtctccccgtttctccacgataaccatgattggccacgtagcataaaaatctcaaaatttccagccactatttgttgaaaaatacttgtaaattatccagccactcatgatagagatattcatcaaataacaaacagtggtttaccagcatttgacagagctctttgtcaacatattcgtccaaacgaaatttcaaatccatttgatccaccaattcatcagcgattaaacaatctagctcctgaaaatcgtccagcatgtacatcaagcttttgcgatatttgtcctccatggtaagtgaaagggaaaagtcaatgtcatcataatgagaaattttcgttatgtggggataactaccaatttgaaacaaaaaatggatccctactgctttcttcaaagtataatcatgcaaaatcacgttgaaattcattaacgttccgtaatcatccaatgagggctcttccaggtaaacaccatcgtaatcgtcaccagaatcttctagcaggtcaccttctttacctctagccagctcatcaatgtcgaaagcaatgaataccttcttatctttatctatatcccgagacaacagcatgagcttgtagtctaaaacgttaaaggtggactccggcagcttgaggtacttgtgaagattttctacagtgaatccggttttctgttgaaatttattcaacaattcaggaaattgaggcaatggtacagtggattctatctcatgtcttttcctctcgttgtttatggcagtgataatgtgattcgttgcaccctgaactttaattgattgagagctcacaaatctcaatgagcgactagacaatgcaccatatctagctaacctagtcgcatggaagtttcgaatcattaagaacgtggttgatgtgaaggtgcgttaaacgattaaacaattgatttagtggtgcgaacccagatgctaaatgatacgttactcccaaagatgtacgatgttggatgtcaaaatgaaatcgacggatttctgaaaacttgtttccccagtggtgtccctcctcctccaaatctccccagatatccgagtcgcgggtcattgtctctccaccacgaccaacaaaatgttgtgaagaccatcaccccccggacatttctcggagtttgtatccaacgagagcaccaggaataaaatgacagaagtatatttttttctctctcccatcaccttgacaggataactccaggcatatttatggggaaacataatattctttcattaaccccagtattaaggaagctcaaggttcaggaagatcgctacacatttgatcgtattctggcctattatgccaaatttcaccaggcaaaactaagtctgaagcaaatagcccagtttggacaaactccgtctaccccacagattttcaggtcatccgtgttccttttggatgaattaccggttcgtttgagcaaacgaataacgttactgagaaatcccccggaaattatcagggaaagaggactgcaagctccttttttggaatgggctagaacgtatgaaaagacatttgtacaagtattgaaattcaagcgtgcttttgggttcatgaacaatgaagatgaaatctcacgcttggtggaccgtgtccattcagaacactcatattcgaacgtaactcccataaccactgagttgaaaaaccgactgctgaaagaaagtgacgtctcgggaactctgatgaataaagacattgacaatgacggcttttccgtctttggtttaataggcctgaaatcgctagcatcgaattctgctgaagtctctggactcaagaaataccttcaggtagcttatcgctctcatacagagatccacagctatttggaagaggtagccactttgtttcaattgatattgaaaaaccatagtaatgatatactctcatttaccaaactattgatggaacatacgggcaagaaacagctatcaatgaacgagtttgataatcagaaacagattcacaggtatctgaatatgctgttcagctctagaataggaaccagagtcttgttggcccagcatcttcaattatacaaaatgagcaccggaaaacttcgaagctctgtcatgaagcaactacaacatcagggaatgaccggcgttattggcaccaaagtagtattatatgacattattaatgacgccatttactcagcagaggaggccctcaacagatacttgcaggagtcaaattcgtctattgtggaaccacctgaatttgagctgaattgtgaccctgacttgactgtgacttgcattccagctcatctttggcatgtggtatttgaagtttgcaaaaattctttgagagccacagtggacaatcatatccaaaaaggtgataccagcaagcaaatgcacccaatagtaataacagtactggagggcacagatgatgtagttataaaaattgcggataggggaggaggaatttctccagaggtgttaaaacatatatggtcataccactattctaccaacaacacggtagacgcagttcagaaacttactcaatctgaaaaagaccagtacactctggtgaactccgctcaacagggggctgaagataatgcaccaatggctggccttgggtttggattacctcttagcaagctcatgatcagacattacggaaatggagatctgcacattaacaatctttatggatatggatgtgaagtatttattactcttaacaaaaggggagacggagttgaaagaaaactgtaaaaatatccggttcttaatatccagtttcagtgatctaattacttgatcaacggttagttgctttcttttcagtcaacagatatcccataactatacatagtacaatgaaaatcattaatgattcactaaactcggaaaaccgctttctccgctgataactgaccctcctttcctagtctgccggcttcctctgcaagatcaagtccgtttcccaaaactctagcttcaatagccagaatatcaccgttcgtgatatactttggagcgtaggcccaaaactcctgatggctttgttcctcgccaggttgagctttaaagtcgtggtttgggaagtgttgatcttcgcccaaagtagtgtaggccaaggtggctgataactttacatttctcttcagctcgacaccagcctcagctagattttctggataaataatttgaatagtgttcagataagcttgggaatgatcagcgagagcgtagtgagctcctctagtaagatcaacttctccagtagtttggtaagcatatattaagttctcaccggcatactgcttgatttgagtaaagacttcgtcgtcatgatagtcaaacaccttttcaacgcctatggcttgcaattttccgaaattcttcggagaagctgtggctaccacattcagaccatagatctttcttgccacctggatagccaaatatccggtggcagttgctccaccaagaattagaatatacttggagctgttatcaggattgctctctcttaatcccagatggtgatgaaagctatttcctatggtgataagacccaaagttatagtagccgcattctcaaacgaatctaccttacctgaaggaattcgtgattcttctagacgagacttgagagtttgtccgtaattgatactccatctggagtcaacgacagcatactcctgaaacagtccatcagtcggatggggtatgaaaccaccatagccaaaggaagagacatgatctccaacaccaaatccctcaacttttggtcccaccttgaggacgataccagcagaatctgctcctacaacgacgcccctcttactccagtcaaagacggcatgtttccaatcggtaggatttgccgccaatgctttctgtttgaccagcaattggtaatccttgagatcagtaattgtggggatctcttgcacctcatataatggatacgctccacctggtgttcctgctatgacaaccgccttgtgtttaggaggaattgaggacattgaactgtagtaaccgaattagaatctaaccgggttgaatacgaagggaaggaatggaaggacctccttttaaactgtggatgcaatttcgaaattactaatcatcaaaagatgaggtagatgggagaaataaaagatcttgggtagttcatatgatttgcaagagaactatagttttcagtccaaagaaaagcgtaaatgcagttcagcagaggcaagacgccatttgatcaatggtaaacgttgggaagatcctacaagaaaggttgccttactgtcaactttagtttatagttcacgcgcgctattaagggtcctgtggacacgtgatcccatgaaaagaacttggcaattgttgtgccaagttaagccccagtcgatatttgatgtattccatggatatcagggaaaggttaaaaataaaacgtagaagtatcgggtaactggttgctgacccgcctttttatatctatgagtattattctatctaaactaattaatgcctctctaaacgaatgacacatgagttctccgtttcttaacctgtgaaaaaggtttcgttaacgagaactggttatcaagatgctgctgcattgcctcgtagccatgcttttcacataatgcttggccatccatgacaaaataatcatcataaatgcgcacggagcaaaaagagcacactaaacaatgcagatgaaatttttctaatgcctcattctcaagacattggccttcaattacttcatcacaagtacgacagacagatccattcagttcatgaaaatgtcttgaacagtaaggtttgtcgtcaaagacatagcattgagatgatgatttcttgaaaggagtttcgcaaactgaacatccaaagcagtgacgatgccaccttcccgataaaagtgagtctttcgaccaaattgattttcctgtaatttctgagttacatttacgacaaggtccagttcctggaggaaataactttgccggcggcgtcagagcttgactattctgattattcaccaaatgaccctcaaactctatactcgtggcatacgagcaatttcttgagttagaattgttgatcgtggcatccatgatttcttcttggagcggagacgtttctggagtgccagaatatgctatagaatcctcattaaaactggaatcattcaaaggatcccacattgtctgtagttgcaatctatctgctttagcagctagatcatctaaatcgtccacatcagcttgtttccaggtgatactggctttatcatcagtttcgctgacaatctcagttgcctcttggattgttgtcatttgactttgtaaatctctgtagtttgcgtcgtcttcatggtactgtatgggggaagaagacgatccgtatgtactattgtatgctcttggggtgctggatgggtttgagtggatcttgtcagatttgaattgctcaatgtcgttggcttgtgggctaaacaatcctggtgtgtttaaaagaaaagacggcagctcattttcagccatatctatgggaagggatttgcggaattcatgattcatttggtgtaagtgagtcaactgatcgtgctcactgctatcgtgactttcgtatcgtgcgatctcttcttttacttctcgatcagggtctgtgcttttatctacgaacttagaatcaaattcgtccaacgaatcgtagccctcaagatcttccaccgcattatgatactccgagtctgatgagtctttctcattttcatgatgatctatagaactcgttctttcttcaacacgattatcaacttggtctttcttgtttgctccgtctgcctgtactatggagctacccactgatgtaaaccttgaatttttgttagatgcagtagatggggtgcttagtgcagagttaccaaagttgaaatcaagggattggttggtgaaggcaggagcagaaagaggatgagacgtatcatctgaatcatatgttctcagcctgtctatatctagctgtagtttctttggattggcagtttttgtataatcaatcgttcgatcggctcgtggcaagtaattcaactgggtatcactattagttactaaacctggagaagtgaaatttctgggctctgttggctgtgacaaatggctcctctgtcggggcttggaatcagtagcgcttaaggaacgcgatctagagctcttaccggcttgattcaacgattgattagaggaatttcgtggcaccaacacatcaaatcctgctctctcataaacgccacgatatcttttatctgttgtcaacggtgggaacgctgaattgaaccggacgcctgcacttgccaaaggagaggcttctcggatgaacttgggcatcgttctcaagtatgcaggagagattggaggtccgctgtcattatgctgagctgacattctcttgatgctaaaacgggcagctggagctttggtgagaattaaattttgattatcttggtaaatatttacgtgccgtgccttcttttccactcattaagtaaacgcgcgcgcacttgcgccaaggaaaacaaagatgatgctccgtatggctggcacacgaccgcagacgaagacggtatgggatagggcaagatgatggtcagccaagtaaacagcagaggccaactaagcgccaagctgccaactcttgaagcaatcttattaattctaaaaagccatactaacagtcccaagatgagtataagttgagacaccctcctcatctccatataatacttttaacacttcagatagttgacgtcaagtcatcatcatctactagctcagcatcgtcatcgaaattggctagcgtattcaaagactgcaaatctccattctctagatccatggtgttcatttgctgctgcatcttgtagtaaatcacatacgtggtagtggtaaatgctgtagacgtaatgaaaatgctgagtaagtcaactatcttatcccaacctgtagattcagcatcgccaatgttgttgattttgctaccaatgaacaatggaatcagtagctttggagacgtgagtacagatgccccaagtacaactgcacctgacaatccaggtaccgccgccaacgctccatttgataatgaatagggaagaggacacaatcggatcatactaaggataaacagtgactctttccagttgtttcttccggtcaatatagccgttatggctttcagtttagagtgagactctaccaatctaaccgaataatcatgtaataagtatcgaaataccaaaaaagagcttaacgagcccaaaacagtacttgtcattaacaatggccagccaaaggaaattccgtaaaccattccacatagggtgcttaacatagcatatccgattaacggcgggaaagcaactgtatagactaagccaaacaacattaaccaaccgtactttatatctttgaatccagttgccattgattgcagaaccgatagcagcctctcgtgatacacgagtgctagcacaccaagtgctgacagcactatcatattggacactataagtgcctttttccatattggttgaccttggaaccaagaagctaactgtgagccgtaaacttgggcagtttccacaaagccacggtccaggtcttcatctagacttattccttgatggtgcattatagggaagtcaggatggctgtgtgttattgaagtccctggtaaccaagcgaggcaagcgaagaggagtcgaaggcagtgagaggatgaggtttgatatctgtctgctcgccagcgaaacttctaatctaaggacctaacagttatgattacctaaccagaaggctacttatactaaatcatctacatcattaggcgacggattccgtccacagtccactctcctgtagtcttgttaattcggcatccgaggagtcttctacctgtgattggacatcttcctccagtctcttcatccagctcagagctagtgagatgcttgaaaatacaggtgtagcaaaatacatatcccgtttcgatgacggcaggattggtaatctgtttatggcaaagagggcaagtaccgtcattgctctgtgacttcttcaaaagtttcttgatttttctatcagcaagtaagtcttttgaaaggtttattgggggcggtaactctgagtcgctgaatggatttcttggtttgttcattttagttgcaaaatcagaggaattccaccattccagaaacttcaagagaaagattgatgctgggaatagtgttcctcctgtgattagtaatcctttctttaatggacgagttagatcggaatacagtaaatacaatgactctgtcaacgtgataggcctaattctattattccccgttcccaatttcccggcagatgtcttattgagaaacttgttaactctctgttcatccaggttgtagtcatagctgttcaatctagcatatttcatcttgaataaccacataatgatggacggagatttgaatgtgcctgaaagatacaaaacctgcaacaagacttgaattgtggtcaatacactcaacaatatggggtacagcttcaaaaagtagtattgaacaaacgttttgaggctttctttggggtctagattgttcatcattagcttcggatagagcttgtcatacaaatggtccagcttatctcttaaatatggcacgcctacaatctcaaacaaagatacggctatctgggtctttgaaagccttcgcctttgctctaatagggtaggaacctgtgattgtagccgttcggtggatattgtttggtggttgcgaactttcttcaacccataaaacttatcgataaatgtggagttccaatgactcagttgtcgaaattcaataaatccccgaatagccagattcagttcatcaaaatgattagccaccttcagcaagtaccgaggatagcgttgcgtataatggactaagatatatcgaatggatggagtcagcagtttctccagctcctgtgcagaaattatttcaaatagagtgggagtctctgaatccaaggaccttgagtccaaattggagtaaaaatccatttgagacggagcttgttatggttgagggagaaagaaaaagtgctacgactagcggagggttagacatcataagcgtaagcgaaaacaggaagagcatgtggagaaggtacgataccagttcgcgctagaccaaactgaaaacggtatcaagacgcttgactacctagtttagttttaattgtttattaaaagatgctaataatcactgtcactctcgtcatgattatcccattcaatgtagttgggactgataaacttggctgttcgtctcagaaataaaggatcaaatggaaaataggccgctaggtccgaaaactcctgttttgatgtgagatcccatgaaattcctgaacctgtcgttgggttggttgatgaagtggaaccggttagaccttttcgacgctcgcacttattagattcaatgatggaataacaatagcagatatcctgttcttgggatatgcgggcaaagatcaaaacaacgttgtcattgcaaaacttgagcgggttaaacttggacattatgaccctctggaaaaacttgtccaggttgcattcccatgtgtttgcatcagtctttaaagacgaatagcggaagcaaaatatgtagagtactgattgaaatacagagtagaacattttgaaacgatccattcctctaccatcattgatttcttcttctctttcgtggatgtatttctctatccaggagattaaatagctgataatgaacacaatctgagatttcgacacgttcttagctcttgccatatatgaggcaagatattgcatggacttgattctcttggaaaccatttccttgggctgaaaagccacatctatcagtgtgactaaaaatgagtccatcagttcagattggtattgtgtgacatgaaatagaagatactgaacaactctggtgtagtgcgtaggtaaaatatgagttctgaacattgatatgagattgttgaacgtgattagtggtttatcatcagaagatacaaagtatgaatctgttgtcttcatcaagatcatcatgatggaatctaatttagctgaaagatccgctacgtcaatagcctctgggccttcatctagagcaacactttcatcgaagtcatctgcatcgtcttcatcgtcatcggaatcgtcatcttcacttgcactatcggaatcattttcgttgtcatcaccatcttccgtgccctccatagcctctaaatcttcgtcatcagcttcttctatttcattctgtagttcgacgtctaatttgatacagttttccacaatcaaactccagcaactcaagcccaactggggacaatactcactgacgtaaagcaaattctcaacgtagtgaaccagatactttttcttgtcgtttctattagggaacttcttggcgagctgtttctggatgatgttggtcgatgtaggcaccacggaaataatatacttaagagtgtcatgaagtagcttaacattgccttccacaaaacgagacaccagcttagaaacaatctctaccacccacttaggtgaggcagaaactagaacacaaaggaacttgcaatatgttgtacttaagtctgaatccttagtctcgacgttaaggagaccttgaattaaaccatgacatttgcgggtatctattttcccaatttcactgcttaggatactaaatatggcagttaactggtcagtctgtaagctttccggatgcgataggggcaacgagagtttgtatatcagtttatccattttatccaaactctcctcattgtctaaggagtctatgatagatttgatgtaggatttgatcattttgtcagaaaatgatgtcttgtcagacgagtctattcgtatccgtttcgaattggattcgctatgctcatctatgctgtgtttactacttggctgtaaagacatcatcatttaccagctgattagtatagagtttaatttttcttttttaatttttttttgtaagaaaagttctttctcgcgacttatcctaatttggtgacttttttggcaatgagcctcattatgtaatcattacagatgtggctagaatagctgaaaaactctggctaaccagaccaaaccgggaacatctcatgcttttgtttgccttgccttttgttgcatattttttttccttttagccttaagcctttcctctcaagatcaatcgatgagcatcacccttcaagcctacctaatctaaaaattaaactacgtcgttctcttcgcgctcccatttatctgcactgtttctccatacaattcacaggatactagcgtttgccactcacaataatggttgacctcaaagcagagttatcactgatagaccaagtggaacttaggctaactcttcctgagacccaggaaaaatttgagaaggcgcttggtgtttttctgtgtcccttactgctgaagttttatctcaatgagtctcagatccatgtcaagctgtacaagttcttgaaccacatatccaccagataccaatcgtatcctggtttaagacttcctctatctaagcttttggatcaattggagtcacccaccataactaagaaatatgacgaccccgagctgcacgaaaagggacttatttcagtcgcctctaacactcttattttcgttaacaaagccattgacagactcagtgctcaagaatctaaagattacctagatagattgattcagttgatctcaactatactcaatgtggcccaattgagatataaactttacaatatagttatcaagattctcctgaagatagataatctctcagacgtcaaaactaacctaactcctgaacagtttcaagggtttatcgaaattagtcatagattcttacttcttccaagcttacttaccactgaaacaacaataattcctggtattcctgcggaatctgctttgcttttttcaaaattcaatttggactctacctttactcaaaataagataaaacttgtggactactttaatttcataaacattccaaataacttaaaagtacttccgtttttgttggcctcatgtgcatctagagatgatgtgcttgtgggaaatgctgagacctatttgcatcgtcttcaacttcccaccaatccagatcagtacgtagttcaggttattgctgatctacttgttgggaaaaataccccccctttgtcagacacttcgaaacacaagttgctttcttttatctgcaagttaagcgacatatctgttgtcgatatttcacagttcacctctatagcactacaaggcttgcaatctgactatgacaaactgaaagatctatccaccaggttcattgacaaatacatcaacaacgccaatacaagtgatgaaagtattcaatcatatagagagatttccgatctattaattggcaatatttcaacgggtgccctatccgaatttcaactatcagcgcagagtatttcgtccagcataagggctctaactactattttaactcactatcctcaaatattttccgacatttcggtcttgttcaagttagtcgacatatacaaactctattccgataaggagattaaacaatatttacgtgattctatcaatactttggttcgttcgtttaagatttccgatcaagagaatgttgcccaattttgtatttctaatctcaatcaacaagctgataaagacctgtctttcatattggttaacttattgaatcgatcccttccctttcacgatcccagagctagagtgtatacacttatcactgcttctgagataaaccaagacttctcacagttttcaagtttcttgaatccatactattttaagttggagatttcagatgaagatgtgaaatttcccaagtttgatgattttatttcttttgtcgctggagtatccattcccgagccagcattattccatgtgattagttttgcttacaattgtttgacagtaccatacttgaaagtagagctcaatgagaactgggaaagtgttttaagttcaagacaagaagatctggcttatatactgcaggaagtagccaaacaccaacccaaaaatctggcaagtttttccaccctgctctgccaaactgttaacttgaatttcacgtcgataactcaaaaaattcgtttattcaaaatgtttttagtcgcagctcctgattcaggaactatcgctctggatactacttctttgctagatcccagttttcatatgtacaattatgagctggtggacttggtgctactggttacaaaacctacctcaacaggtgatactatcttaaaccactatttggatgtgctcaattcagtcagagaaggacatgagaagttattcgatgaattagtgaagtcagttctgtcaaccctagattcgctgagtaagaacagttctaacaatgaagtcaactttcatcttcatttcctatatttaactcttcaaagattgtctcttttcggtattgtctccaacgggtaccttaagatgatttttgatcagcttatcgaagattccgtgtctttaaagctaacattaaatgcaagctctaatggagattattttactactttatgttacgtggtgtcagacaaagaatcatttgagcgtatagtgggactgataggtaagatggcaagcaataattcgaaaaaaaatgaccaactttttatcattggtgatgctctcagcattgctcttaatagacggacagccttgaaatcccttccattgcaatcacagttgtccttttacgaaacttactttcagaaagatttgggtgtgagcttcgaaccgattactgaatcatctgaaattatactcagggattttattgacactcttactttaccttttgaggatgcccacaaggatgcaagtttcatcatcagccaatcgaaactgaaagctcatactatttggctattctgtttattgggagatattcttttaaccaacagtacaaagagtttgttggtaactgttcatcttgtctttgtcagaatgttattcaactactataaaggctcaagtaatgttgattatgagttgattcaagaatgttctttaaagggattatttttgttgtacacagtgtcgccttttcagaaaagtttactggaagagcttcaaatagcttacaaccaaaacgtcaatagcaacagtagaagtgtttttcaacaggttaaccagtcaaattccacagtgtcgtcaaaaactttcaaagagcttatcaggttgagtcttgagctgaatggtataaagtacgtgataaattttttaaacgtcctggtcggggatgctgtaatttggtcgccaattgaatcctactaccatgaacaatcacagttaccggagaacagcatttcgttgtctgaggagacgaatatcagactagtctcaagattatatcctttacaattttttcctgattcaaacgtcaacaccatcatcaagaagatatggtcatccctttattctacaagcgacattttagagcattctcagaatatactagaaactgtcattgcaggatttaagaacaaggattggaagattagaagctgtagtgtcctttccttgactgaactcttgaatattctaaaatttcgtacctacgagcaacagttggatcagatcattggtgtaagttttaggtcgttggacgatgtgaaggacagtatccgaacagagagtgaaaagttaaacagaaagctgatagctgtcgttatcaacaacgtaagctcgaccaactctgaggacatattaaatctaatcattccatttttactgagcaacaagggtttgctcagtgactcgaaagatattcaagggttttcccttaccaccttgttaaagctatgttctaatgatcggataaccaagcatattttgaagtttattccagaactagtgactacgttaatccagctaatatccagtctagaaccagagatggtgaactatctctacttaaatgcttcaaattataatgtcactactgaacagctcgatacgcaacgattgtctatgttgaacaactcgcccgtccaagataccattgagaagctgatcgatctgatagattcttatgatgagcatcttgtaggccaattttttcaagatttcaataaatctattcgaagagctgtcggacttccttctaaagttttgggatcaaaagttcttgtttacatcctgttgaaaaagcccgcggcagtttcagctaagaatggagatttgcttcttaaaactgtgatcaaccaaatatcagatcgcaatcaggctgtagccacagcatatgcaatagccataggtcacgtagtacgatttgcttcctttaaagtggtcaaaaattttgcgagcagcacattactgtcctggtattttgagtctaatatcaacgaggatttcagtgtttttaggagaagacttttgtcaagtttagttatcgattctgtttttaagaatagcatcaatattgcaaatagcttgaggtcccttctgttaccccttacattcattggtaagcacgatattaattcagaagttgctgaaagttttgaacatgtctggttggataatgctaatggtgtgacaagcatcaaacactatctcaaagaaatatgtgagatgtgtctacaacgtatgagttctcaatctcatagtgttcgacgaatttgtgccatcagtgttgcagatgcttgtaccaagatagatgacactccagctgattttgattctgcccttttggcccagatctttgaagttttgataactgcatcacgaggaaggacatgggacggtaaggaagttgtaatcgaatcgttggtctctactgctataaagttcaaacaaatgctacaaggtccaggatttaagagcacaatcctcaatgtgaacatggttctactgaaagagctgcaaagatcaaagaagacaaaaaagtatgccatctttttactgaagtctgtgtctcgatacatttcgttatattcctccattgaggaagttgaaggccaatcgttaactcagcaatttttgaatacctttgagcaagtctacaagaatttttatttgagcatcgacgacgataaggacttagacgaggatggtgatatcgatatggaaccagaaggcgtgaagtcccaattgttcaaaagagaggaatccaaagttgaacttttgcaatcgcttgcagattcgttcacaattgtcaactcacaaacgtacaatcacaagcagttggacttgcttttgaattatacgctggaagtattagaaagcaataatagtacgggaagcacttggagatcccaaaactgtgcaagtatggtcctaaaaaaggtcttgcaagtattcaaccaatcccttcaaaaagcaatgggctactattctctgccgaactactgagcagtctttcaaacgtttgggatagactttgggtcgtcgtcagtgatggatcaaccgttggaaacgtacaagtaatgcttgttagaacaagtcatgagttcttgaagtttcttagacgtgtcaaagagtttgacgggtcaattatcggtttagttgccaagtatcaagtacttgtcaccgaaagattgccagggttatccaaatcaaagaacactagcgccattttacaaaatgagatacaaacagcattggaatgagataacttggaaagccaatcatcaattgttattctacctatataaagaactatatagcaacctaaacaattgaacaaagttcaccacctctaagtcttaataccaagtgaagagtggattccttttgaatattgtaatcagaaagagttctaccgtcttccagttgcttaccagcgaagatcaaacgttgctggtcaggaggaataccttccttgtcttgaatcttagatttgacgttatcaatagtatctgatgactctacctcaagagtgatagtcttaccagttagagtcttgacgaaaatctgcataccacctcttaatcttagaaccaagtggagggtggattccttctggatgttgtagtcagaaagagttctaccatcttccagttgcttaccagcaaagatcagacgttgctgatcaggaggaataccttccttgtcttgaatcttagactttacgttgtcaatagtgtctgatgactccacttcaagagtgatagtcttaccagttaaagtcttgacaaaaatctgcataccacctctcagtcttaaaaccaagtggagagtagattccttttggatgttgtagtcagaaagagttctaccatcttccaattgcttaccagcgaagatcaaacgttgctggtcaggaggaataccttccttgtcttgaatcttagacttaacgttgtcaatggtatccgacgattctacctcaagggtaatagtcttacctgtcaaggtcttgacgaagatctgcataccaccccttaatcttagaaccaagtggagggtggattccttttggatgttgtaatcagaaagagttctaccgtcttccagttgcttaccagcaaaaattaaacgttgctggtcaggaggaataccttccttatcttgaatcttggatttgacattatcaatagtgtctgatgactccacctcaagagtgatagtcttacctgttagggttttaacaaaaatctgcatttttttaaagttcttagtatgttcaaagtaaggaatacaacttacaattggaagaggcgaatggggggccttgtgactatttatattccctcttaaattggtaagggtggcaatcaaaaacataaagcgacaaacgtcacgtgaacaaaagagtacagaaatgggaatagagataaaaagaaacgagagattagataagaccaggttaactgtaatcaatcagctcaaaagtatacaacatcagatcagtagtctaatttactgtgcatgggccaaggaatggatcaatctggagtagtaaagactgtgagtagcagtagcctttgaggaccactacaattcattttagagagcacaagttctgtccagcagactggaaaatacggcatcccgattcctattttggaaattcttagaagtttaaagtaattccgggtcgtgcagcagataatgtcacgataaaggtgaaatatatggagcgggtcaagtatatgcccgaaagagaaatagtaaaactattcttgataaagaaattaaagtggtgtatttattaatcattattacatattagctattagtatcagtataaaaagggttatttgggttaagacttgggatcattgccgcttggggtttgggagatattattgatgtagttgaggcggaggaatgtgtaggcgaaaacaagtttgaggatgtcatgctttctggttggcttatcacttcctgagcattcttgtgtctctttgtgggagaagtcaaacttcttttcagttgaacagaaattgggccaatagatggacttccttcgtctatgacgtggagtagagatcgctgcttccttggacttgaatgaaaactgtttttaattggggatacagaatcaccctgaaactctccgcctccatcttcttcgtcgctactaagaacattttcaaaattatattgttgcggtagtccagaccgtgttatgtctagactttttgttgaccttggtgccaatttgaaatcgagagcctcagtcagctcttcgtcatccgaatcaatatttgcgtatcccttttgagaattcttcttgactcctggcttggtcatttgagttctcaatttatggtaatcttctcgtttacttgcaagtttctcctcctctgtaagaagataagacacataccgggctttgtttcgtatattcagactctgcatttcctgatcaccatattgaaattcttttaaagtgtttatcaagtagcaattccttttccaatagttaacaaactcgttggagccactctgtagacaaaacaaaatcactgtgagacttttcagcagacttttccattgtttgttcttggtcttgagtagtcgtttacgcaaaacactgagaattgtctgaagcttccgggggtcaaatgtgtgctgacttatgtattgcaactcatcggctgtgggaccccacagttcgttgttagtagcgtgctttattcgcaactcaacattggaggagttctgaaatataagcttgaccctgtcgcctaatcctggggactctttcaaataggattgtcttatcataggctacaagtggagaaggcggaagatgtggaagatacggagagttgagagaagcaggatggatgtctgatgtctttagacgattcgcgagaatttcagatgacatatgataagtgtttactataatatacaatttatgtatgctaccaaactttatttgaataaaaggctactgagctaaactcacttgaagaatagatttgtcgttggccacaaatattttggatccagacgtgaattttgctttcaaaattgaggagaccgagcattcattggttcttgtccagctccgtgccttcttgctgtacttgaagagaattattgagctggcactcgcaacggatattagtgtacttgtagggtcaacagtaaagtcagcaattggaacatcaccgtctacttctattgtgttggcaattgtaccctttcgcaggtctacaactgcaatatgttgtccatatgaagcgagtagccagtagccattgggtccaaattgcagctgcgagatattgctgtcttggggtactaaatcaagtgttagaaccttttcaccttttgacaagttgtatatttcaatgacatgaccattagtacctgccaacagatcaccatccacatgaatgtccagctgcttgaaactgattggaattgtgtatacaaacttttgcttgtccacatcgtataccctcaattcttccagagtttgaataattaataaaggaagcgaaggatgcggtttggctgtttgaatttctttcaattcagctgaattgtcgttttcaaatagtattctggactcagatacaacgtatgctacattcttgatccatccagttgtaacgattggttcattaatttgatcaaactggtgtatctgttttccatcgtcattctgaaccaataatacgacataattgctaagtgtaatcagagtcctgttaatagtttcatttctttcaaagtctataatatcgctgtctttaatctcatttgtccatataatttctggttccttgatctcaatatcagcattcaaatcgaacttgctcttcaccttctccgacttgtgcttctgtaaaagctctttctgcgcagacactatacgtgattcaaacgtctcttcctctggagcggattcttccagtttttcagcatctggcatcacagcatcgccattactaatattacctgctagttcttgcaatccctttctagcctcgtctctttctcgtatggcctttgctgcaactctgacagcagcatcgtgatggtataaggctacgcttagttcttcctttgcagtcaccaattgttttctgagctgaaaaacttccagagcaagggcatcccactcgttttggaggctcgacaacaaagaggggatcgatgtggctgtggtatgtttcacaaggggaatagggtcagtatccacaattataagctcttcttcggtgagactctcttccgttattgggtctgtgttgttgttacttttcaggtaccccaaaagtgtatctctgtcgaaaattcttttgcttttgggagagatgaccgggttcgtagttggtttcccagacactatttgatttgttagtatacgtcactattttgaccggacattgaaatacttacaagaacagaacatcttcggtggtgaattcagatgttaaaaattagtttacatgtttttgctacatataaaagtagaagaaccctcgacaagttcgagatttcaaacatctgccgttgtccccattctctctcattgacaaaacatggccaccaaggacagactcctcaaactctatgctggaggccagcatgtcactatgtcgcctgaaaaactaaacgatgtatattcattgagcaaacaattcacggcacttcttacgtccagtaagaattcctattgttccgaaattgaatacttccagctaatggagctccagttctacctagctctacagacaaaccacgatgtggaggcaaaaaaatgcatggatatcatgacagacagattcaatatcaatgaatcggaaaagctgattgggctgagagctttgtacttgcaggcaactgtaggaaacgaacaagcctttcaattgttgaagcaatcgggagagatagccactcgtggttccacattggaaaacacatctgaagatttattacatttgaagaaaagagctgttctggttcatcaaaatgatcctccggagaaatacgttgagatgttgcttaagttttcagaagtgactcctctggatacttctgtatggaaagagttggctgatcaatatattaagcttaatcattatgacaaggcaattaattgtctccaagagatcttattaatacaaccctttgcttacaatatcatagcactacttgctgaaacagaactacagtatatcaaacagttagaatcagagttgaaaggtccaggagcatacgtaatcaaggacaagttgagagaggttagaatctcatgccgaagacattttctacggagtgtggaattatgcagtaactatgcccgaggttggtcaggcgtattagctgtgacaagtcaagaaatctcaccccagagagacaccactgaggtgaaactacaccatttggctacccaaagattgaaagagattcaagagaaaaagttgagcagtgacgaaaacttgaagtatgtcactcctatcctcacaaagtatcaatcatagaaacaatgtctcaatattattcattatccctaattaataaagtaaggaacctgaccttcatgcaattatacaacaatcagttttgttatcatttctcctcataatcatagcctccttgtaaggatttatcatgctattggttcgtatcccattattttcctctccagctgggagaagcggatcagaagtggcccgaatggtattgattatcatcagacatgagttggagcttgtaatacgttcgcgagctatattttgtttcaaagtgttgttaagctccgtgactctcttcaatttgatctctgatattttcaattgcattaatagcctcttctcatcaacgttctcctccatttcgtacattttatcactatctatcagtgttgagtgttgcagaaggatgaggagccccaaagacagccacaaccattttccagatttcgcgctctatatgccaggcccacatggagtttgcagctttggttatcagtttgataactacacaaacaccaagatgtctgataattcacagactgaatctcgtttatcctcagaaacactaaatctaacttgtcgcaggccctctcttgataaaattatgctttcttacgcaattactccgcacttacgagcatactatggtgattactactcagttatgcacttgcccttcgacgggcgttccatgtacgattcaagattttctcccccttataatgcattcatttggtgcaagaaattgatttcctgtattcaacccacaaggtaagcgtccacccctcacattagccaaatcttttaaccacatcttggacactagcaaatgccttgtttctagctatacagttcttgaacacctgttatccatagactataaaagcatcacatacaactgcaagtcgctagccaccttagatcttcaaattatcagcttgcatgtccggttgctattgctagagctacaccaacgtaacttgcgaaatcgattcaatgaatactatcggcaagacagcatgcgactagcaactgccataaacgtagagctgccagcttgtgagtttcttatgactcaattggacaagttcttacaggacaagatagtagaaatctggtgcgttgaggctgtgcttggcgagcggtcggatatacactatatgtgctaagatgaaaaatctcgcaagcaaagaaagatccaaagagggtaatattatgtcatcgacgaccgatggttcaatccattactcccaacaatctcgaacgaaaattagtggacactgccgacccctcccggctcggaaagtggttttttcccttgcaaaatccgctcaccacacatctgtcaggtgccctgttcgctttcactccttcgtgcccaaattcctacccccaggtttcatttcaacttccacaccacttcttaccgactagcacaagtttaaactgttttcatctccccgattttgttgaagctaataaacactcactgtttgcaagcaatatcattgatttttcctttcattttgtctgtttttccgtttacttcgacaagttggctaccttgaatcgaattcttttcaaggccgtctagtgaatgatgacttcttctaacaacttttcgaactttcaaggagatggtgacaatatgcttgatccatttactttatcccgatctccaatttttcctacgattggaaactctccatcactaggtccaatcactccagagagtggtgatttgtccagcaccgttgggatcaaaactcgccaccgttcaggaacgttaccgtccagaattactacacaaccaagtcctagcaccctatttggagccactagccctgctctaaatgcagttttagaggatgctgcgtccttgaactcgcatcagatcacaccacagcacaaccgacttcgatctagtagcatccagagttccatttggagcgatggaaataacgacagctctgtttctgtttctgtgcccaggcttacaataaatgacaattcatccctagaatcctttgccggatgcagaacccgctctcaatctaccactaatgtcatgaataatggaatcaaacaggcgccattttaccacttgccaaatccggtcatcgaggaagaacccacgtttgcccttttgaatgaggaactgaatggattatctattaaccaaccttcttttgcgatgactcctatcctagttgatagactacctcaagatgcaatcagttttgtgagcaccttccaggatgcatctcttggcccaacaaacacgttgattttgctgaacctaccccagaatggatcagtcaccagttttaatttctacaagatgttatgtaagtttggaactgttcaaagcgttaggatcattcattgccataacaatgatctaattgcgattgccgaatttgatggggtcgaatcggcaatgacttgtaaggctttgttaaatcatcaggagcttttcccgggattaaactgcatcgtttcgtttgcccgcattatttcgatcaagtcaggcgttactccacagactgcaaacaaagttccagggcaacaaccacctattcaaacttcagttaatgtaccaaaccaattcaaccaaggccctgctccacaccagtcacagcacgttgctcctccaccacgacctcccccaagagcatcggctctcgatgacttcaacacaagtaatgagcctcttcgtaagaaggtcgatctactttactcaactgttgaattatatcgtaattctttgacaccggaggaatcgttcgctttgaaccatttgatcctgggagctctgaaataccacgaggtgaaggagaacaactttggtcgtttgcctgaccccttacctgtcagagattttgactcacccaaactccgtgagatcagaaaagaaattgataacaaccactataatcaaacgcaagtggaagaactctctttggccatgttaagcgaacttccggaattagcaagtgattacttgggtaatacaattgttcaaaagctttttgaaatatcttctccgcttgtcagagatataatgctccgcaagttgtcaccatatatttcgcagatgggtgtacacaagaatggtacatgggcagctcaaaaactcatcagcactgcaactaccaaaagagaaatggacatcattgttcgttcgttgaagccgtataccacatcgcttttcaacgatcagtacggtaattacgtactacaatgttgtctcaagttcaactctccttggaatgattttatttttgagagcattctaagcgactttttggaaatttcaagaggtagatacggtgccagagctattcgaacaatcttggagagtgatctagttactttacctcaagttctgagtgtaacatcgaggatcattatggacgttctcaacttggctattaattctaacggatcccttttgattacttggttccttgatacttgtcagttgcccaatagacacatcaacttaacaaacaacctacttccacatttgtttcagctgtgtgttcacaagttgggtaatctaacagttttgaagctactcaatttcagaggtgatctactttccagaaacctgattctgggcgagatttttggaagattaccattccatgacacaatggcaccagagcctccttctttactaaaaggtattctctcagattctaatgttggaccaaacttcatcttcaaactgattaccactgttcacatggattctgatctgaagaattacattgttaacaagatcaagcaagctttaatggaattgcaactaccttccacaaatgggtacaaaaaattgtttgaggaggttggattccacacagaaaagcaaaccaagcccaaacgaaaataccatgactcgaacgattttagagagcatgatgcctatgtgcttaatccacaaactcatcctgctcctggtgttaaccctgtctacatggcaatagaccagtttactaacggttacccatatcagcttggctaccaggagcaaagactttcacaacagaatttaccatattccagtggtaacagttattgatgaatggaagttttataaaaacgaaaaaaaaaagtgattgacatccgactggatgatgcagcgatggtattgtctccgtcttcttcctatgaaaaaaaaaacagtaataaatattaaggtagggacgaaatgagtgaagaagacgcatatatgacaatatacttaattataaatactttaatgatcaaaataaacagttgtgagtaaaagactagagtacctctatcgaggctcttgcacctcctatgaaagacggtaagaagtcgcttatcatcaagaaaatgatgattacgtaatttctctcgtctgtattggaacacacaaacaactctttccccaacacggaagtacaatcacttaataccttggacttacttgtgacattctctgcagcttttgcttttgaaaatgcagagtaattcggagagagactcttcgcctagtgactcaaatagcaccattgagttgcaaagatccgagaacgaatatgatcacctaactaatacgataatggaagatctggggcaaaaacttaaccactacaaggaatcccaggacacgagctccagccatattttacacttacctactgaggttttgctactcattttatcatttgtgacttcgaagactgatcttcttagttttatgttgacatgtagaaagttcggagacctggttagcggtttgctctggttcagacctggtatttccaatgcatacgtctataaagaaatgatcagaataatgagaatacctccagagaagacattttgggactacaaaaagtttatcagaagattgaatctgtccctggtttctaacttggttgaggatgagttcctatatgcattcagtggttgccccaacctggaaaggatcacattagtgaattgcagtaaagttactgctgattctgtggcgacaatattgaaggatgcatccaaccttcagtctattgaccttacaggagttgtgaatatcacagatggagtctactacagtttagcacgccactgtaagaaactgcagggtctatatgccccaggttctatggctgtttccaagaacgcagtgtacactctcatatccaattgcccaatgctgaaaagaatcaaactgagtgaatgtgtgggagtagacgatgagattgttgtgaaattggtgagagaatgtaaaaatctcgtcgaattagaccttcatgggtgtatcagagttaccgattatgctctagttgtgctttttgaagaattggaatatttgagagagttcaaaatctcaatgaatgatcatataacagagagatgcttccttgggctaccaaacgagccctacttggataagcttaggataattgatttcactagttgcagcaatgttaacgacaaacttgtcatcaagttagttcaattagcacccaagttgaggcatattgtattgtctaagtgtaccaaaataacggactcgtccttgagagccttagcaactttgggcaagtgcttgcactacttgcatctgggacattgtattaacataacagattttggagtctgtcatctgcttagaaattgtcatcgacttcagtatgtcgatcttgcatgctgtcaagagctgaccaatgacaccttgtttgaactatctcagttaccaagattgagaagaattggcttggtgaaatgtcacaatataaccgatcatggcattttgtatctagcaaataaccggagatcgccagacgatactttagaaagagtacatttatcatattgtacacagattagcatatttcctatctacaagttactaatggcgtgtcgcagactgacacacctatcattaacaggtatcagagacttcttgagaagtgatattacaagattttgccgagatcctcccaatgactttactcaatctcaaagagatatgttttgtgttttcagtggtgacggggtccggaagcttcgagatcacctttctagtctctaccaccaacagcaacaaattaacagatacgttaactctcaaaatataggaaacttaagggatgacggagagactttgaatgagatcttccagtatattgcaaatccagccacccctggacaactacccccaagggtccaagaactcgttgaagcaagacggagaaacagaaatcaagaacgcataatgactaacactgttaactttcctgaacaaattagaaggttgtctctcctgcctccggaacaacaacaggctttgccacaaccaattcgtcaactgattgcccaagccactgcatctccgctatcttttcctttacaagatcaggagccacaacagcagcaacaacaagaaaggggtcttggcattccgccagttgataacttcagtccggtagttgatgaagggcaagaatatgatgaagaccaagagatggaataatgcatagtaagaaaagacaataggaacgttaggcaaattcgttagtctaaactagatagtttgcaatctaatttacagatttagtattattgcctcaatcatcgacttctaaccctcttagaatcgtaacagcgttttctgcttcatcttgaaacttcttaatcatcttatcataggttgcttccagtagagctttattctggagagcattgtgaatacaccattctcttatggtcatattcaactcctcttccggcatctcagcaataaatgctgtcaataatccatctgtatcatctgataacccatggaacgaactttcggtgatcttctttagtaattttgcactttgatcaaactgatcaagtgaatcggaaatcactctacgatcacactttttccaaagttgattcgattttgattcattagcctccttcaattctggggcatcaatctccaaaaaggcattgggagaagtggaaagtcccaaaggtgaggttttaaacgacattcttgcaccagatgagtttagatttagatgatcagctggatgttcaccaccttcacggataggtatgtcatgaagagaaactttggaaggggttttagcttcagaagaagttgtgcaagtagctgaattttgatgctgggagttagaattgtccttggtgtcatcaataacatcagtgcttaaagatctgtcacactgagggccattgtgatcagaagcagtgacatttcgactagcattgtcagccaaattttcagatagtaatgtaactttgctggacaaatcgtcttgaatctcattaggcttcactttctcatgttcaaagaaagcatctcttgactttacagatgcatcactcaccattgaaagaactgtcaacttacttagaattctttcttcttctggctgtggttttggaatacttgtagagagttcatcattctgatgagatacttttactattggcttgactccttgattgacgatctggttggtagctgactctttcttatcttccacagccagagcaagctcttgccccccttcttttgatagttgaatactattggatctccttttttcatttggttcctgaaaactattagacatctgcttttcagctgattcctgaatgtaatcggacacctctttttcttttgattcctgatcagtactagataaccgcttttcagttgattcctgcacgttaattgaaacattctttgattcctgatcattactagatagccgcttttcaactgattcccgaatgttattggacacctccttttcatttgattccgaaaacaaaacggaacttaagtctttttgagaatgatccgaaagaatgttttcttcgatcagctcatttgatcctaagggttcacaagaggtcttcacgatagatggatcatctgccatgggttcggagacttcatttttatttagttgaaacggtgagtgttgtctgggttcttgagaattgatgatttgtgctttacgattctcagtggggggttcaacaatgtcttcttcaccaatctgcccaatgtctggcattggttcatctagcattacttcattgtcctcttcaggctcacttatagctgtaattgcaagcttatctggattacctgtatctacaacaatcggcaggttagacaacgcatccgtttgaatcgacagtcttttcttcatttgagatgcaatttcggagccgtttgcttctgcctctgattgagaataaggaattggtaatgcttgatcaaaaggagctgcatctgaaactaagccatctttcctattttcgttctctaactgttctttgggcatttcttcaatcccccaatcctctttctcatttggctgcattccctctaattcttcttttgttgcattatttgcgtctgaaacaggaattttaagcactgatgagtcagatgggttggtcttcgcatatagctctgaaaaatactccctacccatccggacagctttcaaatgccatactgaggggtcactaaagtatattttgactgttagcttgtgcgtggcagctttcaaggtagatgttcccagtcctatctgactgtaatagaatgaatacgacgtatacttctctttctgttccggttcccggcacttgatatactgaaatttatccaaaaagatgggagaagatataagctctgaaattgtgagagcatcaacctttatggaagctttcttggacaactgttcgcttaaaccttgatttccatggagtgaaaagctctcaagaataaatgcggtaattttggaccgagagtttttgctcttttctgtcgctgtgtcttgactatggaaaatactggagtcttttaagttattgtcaatgtgttgctcctttttcgtggctgaaataatcaggttgtttgatgcctgcgaatcttcaacaatttggaagtcttggttggaagtacgtcccctatgaaggcttttttcggttgtgtccacgtcgttcgttatgtaaggagtagaaccgagttctaagtgattaggtgattcaagctgcttttgtgtatcctcatcaggtacgtcaacgtcaatgatatcttctggtgaaaccggaaaaggttcactaacttgatccgcctcatcatttaatgcaatcacattttcggacctttcatcgtaaagagaagaatgatagggtcctttgcgatttgaatcttctcgttcaggcaattcttccagggaattggcatcttccaataatgagtttcgacttactttaatgacagaactgttggatgtttggggattcttttgttcttggatttctgttgctatatttttgctagccatttggggcgaattacgaaggttgatcaattcacctgtgagaccttcttcattgctttggctactggatcgtttggaagggcttgagctaactttattatctggcgtcttagttttccagtcaccatcgctattctttttatcaagcatcgaagtttcaagcatctttaactggctattgttctttttcggagaaaccgagaattgaatactatcatcagaggcatcaagtagtgcagaacgtttgggcttacgcacgtttcttgtcacactgtcgatcttccttttgcgggtgatttcactttcctcgttggtgatatcaacttggggaatactagatgagtgaaattcgtcatcagagagttccagttctctggaattacttgtgtttccaattccatactttttccgccttcttcttttgaaactatgaactgaagaggcaatcttggttttcataggactagacatttcaggttcagattctatgtaagtgtaggagtcatctttctcatcttgtgtggaaacatcttcaatctcttgttcaataattgcctcacttctagaacctcgccgttcttgtgcctcgtttggcacaaacaagagacagctgggattgcttttttgatgttcttcatgtgggttatctgatggctcccacccatccagctcgactccgcatagtgcgcaggtaacagaatcgtccccgttattggaaggagagtaatacatgccagcatcgctcatactagcagctgacaacccttcaacatgctcgtggggccagttttgataagtgttcaagcacaaatctttatagtcttgaatggaaaactccggaggaggtgattcagtgctgagtttcagaaccaataatttcgcatagtaacatttagggctctgctcaagatgccaagcagagacatccgtggagtctaagtggatgtttgaaaaccttttcttacaatgaaaacacgtaacttcatccgtgcggagtttcgtaggtgtaaaataaaagccagcctctgccatttgcgtccctgagggctcaacgtgaggccattgatacaattccttccctcgaggagttgttgttcccaaaaaggtctgatctcgttctcggagatacaaaaacctcttgtcaatcttctttgggggcataagctcgtactagcacgtagatcagtaaggtaaacactcactcactaccataaacaagcgagactggtgtaagagtgttaattaaaaatggtattacgtaagtaatcgtttttaaagagacttaccgcgaattgagaataatgtctaccaaaaatcgagtagtggcagccaaacttcaactccaagagacagctcagtatatcaatcgactgaaatggccacacaagtatgtaaccgttcggctagcagacgaatatgttaattgattagaagcgggatttactaacaactctcatttaggtcttagtgattgacagtgttcatttggacgaagacaaacagatagctagaaatagaagcgtcccatggacaatatatgtcaagagtagagacatcactgaagatgaagtcagcaagttcaaggtccttgaaaagaagggtattgaagataagattgccatcatcgggaacaacaaagacagttacgcaacaacgattgtaaatctcctcaatagaaccaccaaggacgatattattcgactactgtccgtgttgaccaatgacttactaattgaattggacggatttcaagaatctcttttggcattgaacaaaattgattccagtttaccgtatgctgcattttccaagtatttgaacagtcctgatcaagttgtatccttgctttcttcttacaatctgactctccttttcgtcttgcaagacaagaccaagcttgcggacaatttgaaagatactacaccatttatcaatgaattataccaatatctatttgaaaagttgttgagcaatgatgatatcaacctacaattcattggtgcacaattactgaaggagctgctttcagtcaagatttatagagatcttttctggaatggacccaacaagtggctgaaggatttgttgaacttatttgaaaacaagacctcagaccttcaactcaaatactatgctttgttgtctgtttggctgctaaccttcaacaaagatattgtgaacgaacttcctaaccaacatccagaaatcgtccccctacttttgaacattgctaaggagtctgttaaagaaaaactcgttagagtggctgtgtcttcacttttaaacttggtatctgtggataacaacgaagctattgtcaaagttgtgttactccacaaaggtctcataactgtaaagaaacttaacgagagaaagtggaccgatgaggaacttaaagttgacctggagaatctactgactgtagtcaatgaaaccgttatcacccttactacgttcgacgagtatgagaatgaacttaagactggaaagttgacatggtctccagctcacaaggcggagcaattctggatagataattctgctgtgttcaaggaacagaattggaagcatttaaagacgttgttatcactcttggaaggcagcagcgacctagagcccagccaaaagtacctcaaccaagctatcgtatgtcatgatgtcgccgaactattaaaacatctcccagaatcattggatgttctgaacaagcttggagcaaaagctaagattatggctctgcttaactcaccagatgcaaatgtcaagtatgaagctctgaatgctactcagacttttgtctctcttgtgttcaaccattaatctttttagtaagtagagaaaatctagtcgcgattattttcccaataaaaatttttgaacatagcttaagtggaaaccttcaaccttctgactatccctttttagcccaccatgtcgttcgtcaatatttgccgtgataacacggatccgttttaccgttataagatgcctcttattcaggcgaagacggaaggaagaggaaatggtatcaagactgctgttctgaacctacccgatgtggcaagagctttaaatagacccaccatttacgttctgaaatactttggttttgaacttggtgctcagacttcccaagaaagatctttggttaacggtgttcacgaagcttccaaattacaggactgtctggacggttttatcaacaagtttgtgctgtgtggttcatgtaagaatcctgagaccgatatcatcattgaaaaagacggaactttgaccagagattgcaaggcctgtggttccaagacaaaaattgaccctcgtcacaaattggctacttacattgaaaagaatcctcctgaaagtgccaaatctaagaagaatagaaaagctgctacagcttctgccaacgtcgttggtggtggtgtttcgatttcggatattgcctccggacaaaaatccacagatgctgacgccattcctgcagacgacgatgatgatatagacgagctggcacgaaagatcaatgctgaggcttctgcccttccagaagttcaagaagttgctgatgacgagtgggcagtagacatgtctgaggaggcaatcaggaaaagagcacaagaattggaaggacttactgtaaatgaagaacttagtgctctagatgagtttggtgaatggttattgggttttgacaaatccgaattgcctagtgatgttgatatctacaagagagcttccgatttggatatcgtagaggatgaaaagatactgcaagttctagcacaagctttattcgatgaagatattctcaatcaaatccctgagcacaaaggactgctaggaaaactgattactaacgaaaatgctgaaaagtcgttgctaggaggtatcgaaagattagtgggcttacaattcacagatctaataccagctgttccaaaaattgtaatgattctttacgatgaggacttagtctccgaggcggttatacaggactggggtactcatgtctccaaaaagtttgtacctaaagacgtttcaaaaaaggtcagaaaagctgccaaaccattcctgaaatggttggacgaggctgaagaggaggacagtgattgaaaagtaagatttagcttacaaattctcccccttctctatgttttggggggtttcatacataaaaagaatgtctacgttagtttaagatattggaaatggtttagttttgctcagcactgcaacttggtttccatgcgatatgtaacctttgacgtagccaattgctattagaattgaaatgtgctgttctgcttccccagatgaaagtacattttgatttgcttcgtgggttaaactgaagttcaaagctgtggtcatgtctgcaatcttgacgagatgtgagtttcgaacgttgtgaacttgtttcagtagcgtcaaaactggtagctgcctaagtttgagaaaaactacatacagattgtttctcagaagaacctcctccaatctgacaaactcagcgtcaaatgttttcaaatctccaactttaatcgaatcgaagattgtttggtatcgatttttcacttttgaaaactggctgtacaatttctggctgggtagttttcttgtgactagaagctgcaacggagccaataatagtattatacattgcatattttttgtgctggtttttaaacatgtgctgagagcacttgtcagatttttatgagcttcctcaaacttattgtgaaaacagttgaggacagcattgaggtagaggtatgcagtactgtgagatttggggacttttcgaaggctcggtaaagtagatgatgctgaaagtaagactttctgtaatgagctggccaggtcgaacttgttcatggtgaagtaaagtttgaacagtattccagcaaaatagtagactgctattttctttgaagttgcaagatcagggttcttgtcacttaaacaaattttgaacgacctattgaatacatcagcaattttctccaaaggtgcccttgaatgctcgggagtggattgatcacctttgttactattatacaaatttccgacatatttcagctcagtagaaaggaggatcagaagaccgataatccagtttgtttcattatcagcgatacggttgagctgggaaactagatcaagacttgtttcaaacgcctttttgaggtctccatgtttggtaattgatttgagaagcgatagatatgttgagaccaaatcggtccatttttggtcaacaatccggttttgttgcggtaatgcgaagtttgatctttcttgaagaaggttatttggaatgcttatggaaaggagattactcagtgatgagccatcttgaaaccttacagcttgagacacttgttggaagtactgcagctctgacattgaattggaggtccaactggagagagatagatttgatggtaggaaatgacggtgttgggatgttgttcccttgggacagaatgatgtttaacgatgcaattttgatacaatataaggatttgatagacttaaatccagtcaattacttggagatctatccgttttacggtgtaaggttaaaggtgcaaaatatcatttattatatagcagttgcattttaaagatttacaaatggtctcgcttgaaacaagtaaagttgacgatgcaggcaacttaatatccagtggccaaaataaaactgaaatgaaatccatttgagttgattaactattcagttttgatggacaaatcatgttttgtcaagcacagcccttttctttaacgtctgtacttcaacctcatctccagatatattataaaagtgaaatataaatattttaattcgctatttacatttaacccaattcggaacccagaatccttaagatcctatcaaaaagatcgcacaccattctgtaccgtaaacaacacaacattggtatatggccgtcccaagtacaccaccaagaggcatacaatacaagaaatcgatacccattctggctaacaatgatgcactcctcaacacccaaccagtaacccctgtcacacaacgacaagttagcgagtcaacaggactgttgaagttttccataggcaaaaatgcggcatctccggtgagagatggtctccccatgtaccttccattgaaatctgctgtacatgaggacaaggaaaacgatatcctgtttcaactggctaagaagcaacgacaggtggtggacctggctcaaacattaaagatagccaaacaggagcttgcggaactggaacgaaagtaccaatccgagttcgattctagaaacccgtcccctgttcaaaagaaggatcagaatccaccaacggcggctaagaatccattgactgaactaaaacggatcatggagaaaaacaatgaaaaaaaaccatctgcactcaagagcaggaaaagtttgttcaatttgcaacaagactttgaggataacagagcaatccaaaaaatccgcacggattttactactctctcttcgaactttttaaatgattctaagaaatttcagcagggttttgtgacaaaagccaatagtttctttaacaactttaacacctcaggcagcaactccgtagctagcgaccaaaattctttggagcgcaaagcatctggaagttgcctgtatgatgttcgaaagcatgacgcaaaccagacattgatgagctctgaagatgaagatgaagaagattatggcggaaaagcataccgactagacttgtagtcaaatagcatacaaacagcatcaagaccattaaatactcgcctcaactaaaaactcgtcttccttgattgactttactttttcgattagatcaccaagcggtgtatcaagagacgggtactgtctacgctattcacggttagcgtcaacaaaatgtaaaaaaaaagaaaaaaagactgtaaagcccaacttacttttgccaaaaagccaaacaactcagttctgctcatctcttccactggcttagcctcaatgtcaatgggaatgtcatccttgaccacctctgtgtccttcttcttggattgctttttcgatatcgttcgtcggctagagggcttgaaggtggtaaaaaacattgaatacaatgtagcccccacaacgaggcccacaaacccataaaagaatttcttctttacttggtgtaccattgcaatggaagaggttgatatatttaaagaggtccaaggacccgtggaagcaaaataccttcaattccctaccgcgattgactttctgatgtttgattagatggacaatcagcaaatgtacagtaaagcgaaatgaaacgaaattgtcacagcgtttggatggacttaatcaaggacagctagcaatgccaagacagtaactaatacactgcatttctcttaacagtactcaacttccacacttcgtcaggttctggttcctggcccatgcgcgactcatcccccgcctgatgaaatagataaatttttgcatctatgaacttttcactcaaaaatgaagtcgttactgctacttctattagctctctgtcaaactgtctttggtacgatatgggaactcacggacaaaaactttgaaaaaaaagcttttgggcagcaaggtatgtactccttcgtgtacatctactccccttattgcaattattgtaacgagatgacacctcaattcgctgcactagctgatttatacgacgacaccaagttgcaactattccagattaatgggtatgccaacaagagggtctcaaagaaatacgaggtagtcgggtttcctgttttgaagattttttcatctgatggaaccgacatggggtcttataccggtgtcagaggcactcagaacttcattgattatattcatgaagttacaggggttactccaagctttccagactcttatgtcaaacagcctacttcagaggagctagaagatatcataaaagacactaagagggatattctcgttgctttttcacagccttggcttagaggctgggagttcccttacacaaacttttacgaatctctggcaagatattatgctgaagagcttgatgactctttgactaccttcgtcagaatagacgtctccgacgccaagaatgctgagattgtttcgaagtttcaagtttcaaaaactccttcagttttccattttgcctcttatcgtgaatattatgatcaaacacataagcttttcaaagaagatttgggccccgtggaaattgttcaattgctagagggtgctgaggacttagttactgagagcattaggctgtcaacattatcagactctcgccacaaagatgttgaggagtctggggaagcagataattcctttgaagagtatgcccaactaagggaattgtagatagaagtcttcccatttgtgaaggcaagatagaaaccaatcacatacatttggtgtagactagaatggatctatctggttatgtaatcacgatacctttcggaattgtctcgtgtagcaggcgcgccccttcgcatctcaaatcaacagttggcaagtgtcactttctaagttagcactctactttaagaacaaaatgaacatctttagaatcctaggtaagtttccgctctgctcaattgaagaatcaaacccaattttctaaccacgcaggtgatatctctcatttgataagcatcttgatcctaatacatgctgtatcaacaacaaagtctgctcaaggtatctcattaaaaactcaagcagcttatgtcgtagtctttgtgagcaggtatcttgacctctttttcagatatgtgtcactttacaacacgctgatgaaactctttttcattgtctcttccatttacgttgtgtttttgttaaatcggtacaaaaagaacagtgaaaagaccaatgatattttcccagtatggtatctctttggaggagcgttcgttttcgctttgatcttcaactacgaatttagtattgtggagattttgtggagcttcagtctttggttagaaagtgttgctatcattccgcaattagtggttcttcagagaacgggagaagctcaattactaaccacacattacatatttgcacttggattatacagagcgttatacatccccaattggatctaccgttactacacagagggtcgcatggacaagattgcagtcatttctggtatcttacagactattgtctattctgactttttctacatttactacaagaaagtagttaagaacttgaaattcaagctgccagaatgaacatggaaatatagaaaaacaaaagatagtgtatcaataagtatatatgtgttgcaggaataaaaatcagtccttcttcaaaggataatattcagtcctgacgccatctttagtcacgatcaggatctccagcccgtcaccgacgttaatgtgtctctcagtggccgatgaaaatgcgtctctaaccagactgattacttcgtccaattttaagtatttcagttctttctttgctgttccattcgagtcagggtccatttggttcttgaaattcacttgattatctaggaaaggcattatcaaagacgcagcacccccacccgctctacattgttctctttcgtaggaaccgacaggatcaaatgagtagactgctcctttaccttcttcgtccagtcccgcaatgatagtatgcacatagtaaggaaagaatcgttttccatatagcaaatgttgtatgaatcttgccgcagatttaatcgtcaagttctttttatgatcaaaatgataccattttagctgattgcggaatctcttgaccaatgcgtctccatctgctgcgaatccattcgcagtgatcagtaattcgtctcctaccgagaacacttttggctcatatctggaattgattgaatagcctgtggtatgtctggtatctcctgctaaaattgcaaagtcttctccggcaattcccaaaactgtaccaccgttgtcttgaaattgatgttagtaactattgccattgaaatcatgttagcagtcttaagaccgaattataatacctaccagagtaaggattaaactggtgttctatggggacattggatacgcctgaattataatcagacgacactgcacttgtaacactcattaggaatgtagtcggtgatggtagtggcaaacctctctcaattgatatagagcgagatatcttgaaatattgagtggtacacgggatatgtttaatttctaatgatcgttaagtgattcgaaaaggtgctattccagaacaattggagtgaaaaatggtacctataaatgtatttgcctcatctattagttatagagattgtctgaagattaattttctgccattcttttggcttgtgtggaaaacatatctgtctggctttaaaatgtggaaaaaaattacataatcaggtgagcgagaaggggtctagcatcgagtatacctcgtcttgcataacgaacaagtggcctaccagactcatacctgtatcttgcattgacaaattgttctctacaatccgagatggcaacagaggaagagagaaatgaactgagaagtcggatggacgccaataattcaaaagtttccacgttcactacgaacaattcagatgatccttctgttgatagccagggtaaggtgaaaattaagtcatgggtttggagccttgaatctttaattggccctctggtgatcactgccttggcaatttttcttcgagtttaccaaataggaaaagctgatagggttgtttgggatgaagctcatttcggaaagtttgggtcattctacttgaagcaccagttctattttgatgtccatcctcccctgggaaaacttcttacaggtttggctgggcacatagctggctataatgggtcgtttgagttcaagagtggggtgacgtatccagaatatctcgatttcaaggtaatgaggatattcaatgctgttttcagtgcactttgtgcccctgtggcatattggactgccaaatcatgtggatattctctactcacggtttaccttatatcattgatggtagtttttgaaaactcctacgttgttttggggaagtttattctgttggattccatgcttttgtttttcaccacaacaacctttctgggtttatcaaaagttcattcattgagacagcaaggaaaagaattaacttacccgtggtgcttctggttgacctttacaggtttatctattggatgtgtatgcagtgtcaaacttgttggactgttcgtaactgcccttgtgggtctttataccattcttgaccttgccgttaagagatacgatgaaaaccttaaatggtctaagtacttgactcattgggcagtgcgcattctaacgttgattattctaccgtttgccatctacatgttatcctttaagatccattttgctgtgctttacaagaatggagatggtgcttcttcaatgtcaactctgttccaatccaatttggagggaacaaaaattctaattgatgcccctagagatgttgcatatggatctgaacttacaataagatcccaaggcctttcccaaaatcttttgcactcccatgggtcaatttatcccgaaggatctaaccaacaacaagttacaacctacggtcatagagacaataataaccaatggattgttcattaccccgtcctcagcaagaagcaagttaaagaaaatgataactcaacagttccagagatgatgaaagatggtgacaccattcgtttaagacatcaacatactggtgcaaacttgcattctcacagaattcaagctcatgttagtaaacaatactacgaagtatcatgttacggaaatgcaaaagtttcagacggaaacgatgagtgggttgtggaagttgcagagcaaattcattccgatgaccctaaatatgccgctgccaacgaatcagatttaaaattccaggaactgcttcaccctatatctacttccttcagacttcgtcataagagagttggatgttacttggccactactgggatggcatatccaagctggggtttcaagcagggtgaagtagtctgccgaccatcttggacctcaagggacaaatctacgtggtggaacatcgaggaccataagaacaaaaagctgccaaatgctacttcatataaagctccaaaatcttacttctggagagactttgtcatgctgaactatgcgatgttagcatccaataacgccttagtgcctgatcctgataaattcgataaactggcttctcaatggtggcaatggcctatcattaatgttggactccgaatgtgtggttggagcgcctcacaatctagatacttcttgatgagtagcccatttaatacttggttgtcaactgcttctttggctgttttttgcttgattgttcttattttagtcctacaatggcaaagacaaagactcaatctctcttctagacagtactgggagctagtcatcaagggttttgtcccattttttggttgggcgttgcattttgctccattcattgtgatgcaaagggtcacatacgtgcaccattatgttcccgctctctactttgccatgttcctgctgggatttactgtagactatttgacagccaagaggaactgctacatcaaaacattgatctattttgtcttttatgcgggcactatctactctttctactacttttcacctctcagttttggcatggatggccctttaaaaaattatgcgtacttgcaatggttcaagagttggaccatggtttgaggaagaaggtgtagggcaaatattagacgatctatacagacaaaatataaatacgagttgacgtatcactgctgccgactcccatcagtaattttttatcttgtaagtttcgactaatggatattctgttgactctatcaccaggaacgatcttgtaatccagctcattgatcagtacaaattcattgttgttgttgaaagagaacacttttatactaccagactctgtgccaagtgcaattacagcttttccatcaatagcagctttgaacgaatccactgccgtaacttgttcatccaacttgagagaagcgagctgaatcgtatcttttttgatttcgtcgtaactccaagccttgatgtgtttatctctagaaacggtgaagaacgtcgaatctgacaattctgaaggtgcccaacaacaatcccaaataatcctcgagtgcgccttttcttgcagcttaagaagctcaaactgttgcaagtcacttccagttcttttccataaggaaaatcgtctatccctggacacggcgagcaagaattgattgtttggagaaaatttcaatctggtaatggtcaaatcgtgaccttcaagtacctggggcaattgctgccacgttctggtgtcaaaaactctgactacagcatgtgcaggtgtatttgacctacaagaagaagctaccaattgtttgtcgggagatgaatccactgccgtgatttcataaccatgtccgtaaagcttctcaatttcgggccacaaagtatgtctttgcaggtgatcttctaatggaggctgatcaagagcggaaacgacttcatatgaaatattcttctcggattggtcttcctcctcttcgtcattgttgatattttcgtgtgtaacggcagactcgttctctgctttgttagaaaggcctagaacaggcaacgaagcactctcaggcatttcatcaatatgagtttgtctcatgctacagaatttttctaatagctttgcaactccctttggctcatcaaaggatctcagaattttttcttctcctccggaaataaacctattgttactcaaacaggatatacacaccatatcgtaaccatgaatttggggtcttgcaaactcgtgccatgaagttggagtatgcggagagccatccgaattagacacccatcttgcgtaaagccttgtggtttggtccagtgaggttgccaataaatattctccattttctgaccattccaagtcagtgacactttttatagcaccggtaatggcaagctgttggtcccagtcatctccatttgaagatgaccacaatctccaggaacctgttcttccattcgtcaaaatatattgtttgtcattttcaaatatccatagtgaagaccagaacccaccagatgatcctgttgctgttgacgcacccttcatactaagttcacccaacctagttttacctacccaaataccgctgattggatcaggtttccagatcataacggatgtgtctgatgatgctgagagtagctccagtttagttggatgccagttcaagtgagatatccaatcatcgtgtcccatgatgatagcatcgaagtgaattgcacatcgggtctgaccgatggtaaatttgtactgtttattactgagtagtgttaacttggtggaatcctcatcagaaacatcaattttttcgtttagactcagtttccaaagcctaatgtatctgtcttgagcaccactggcaataaaaaaatcaccttcatgcatttttaccactattgatttcacccaatcttcatgtcctgctaatacggcagactgagcaaactttgcaatctttgccggagacttgtcgtaattgaaagaataaacgtaaatattagtgttggtgcctcctatcagtgcaaggaaatctccatcagacaactgttgaagggccagagacaatgagtaaaatccgtctttgactgtgaactcatgcaataattctagatcgcctttgcctgaaatatgccagaaacacaataatccagatgcatcccctgacaaaaataacgagctgccagccaatgcaagactcgtgacactatgcttatgatggttggtggtgccaactaattcgtagtctgtgccattgtcgtcaactttccacaattttattgagcaatcctcagaagtagatagcagaaaagatgtcaatgggacccatttgacacacagcacctcttttgtatgcgactttagagtagtgactactcccttatagtcgtttgcaagagggttccagatggaaatggtgattcctgccccgaaagcgacccgtttgaacctctcactgtaatcactggtatacagttctcgattgcaaccaataaagatactttctactgaagccattctttttactgggaccaagatggaatgaatggggtaaacctagaaaaataatttcagtccaaaaaaaaaaaaaaattagatgttctgatcttagatagtgggtagatatatcagtcttttagaacaaaatccatgagaaagcttcctagaatatctagaactaacacgtctgtatgcttagtaggtattatatacaagaaatatgtgatatatatgtttttacttttgcatcaagcttgaaacaggagcaacaccctgtaatgatcccaccacctttaacttatttccctcaacgttcattccatagttgttgttaagaccattaacaacaacatgagagttcagtttcagattttgatccttgaatttggcttcctcagctcgcaaaaagtcaaaatcccctttcacagaagagttaaatagtttcgttacatcggcagaatcaaacttgacattcgtgatagacttggtatatctgatagtaggactcacatcagacgagtctctaattgtaaatggatattgcgagttcgtattgttggtgaacttcatcaatgtgtttgagatgaacaacggctgcggaatggagctaatgggaacattgtacttgctgaacaattgcaaagtggctctcaggattcgagaattaggagagtaggctagcttagaagaaaatctggtcaattcaccaagattcaaactctctggagagtacagcactttggtctggggagcaggggcattgttgaacctcatcttacttaactgggctctcttatcagtcgaacgagcttttcttggtttatgcttcgcatcagcgcctgaaccctttctattattggacttgtatgaaccagattcttttctcctttcgaaatctctctttctactactttgttgtccagcttttctctcggctcgcctaggttcgggcttctttttgggctgtgactgctgagcagttttcacagatttcaacaacttcagtaagaatgcacttgactctgcggcagaatccgtagcatacgagcgaacttgtcttaatccaaacatcttgagaagttggttacggttgaaaaatatcgtcgggttgaaattcgttagtgtatggtttgctcgaaaaaattaaaacctccaattctccctggttacataatctatttgaactattctccagttcccgtatctaaaattgattgaagttgaggatggtctcgtaatctatgcagatgaaatcatcgtcaatccttgcaacaccatcttcgcccatggttaccccgagtttgttgcggaaagagaagccaagcggtgatgggccccaagacggaacataacacagttgatcccaattgcagacgtctttacacttgaaaaaagacgcccattgtaaagtggatatcaattcgttagttcgttggcccagttcttcccactccttggaaaggtcttcaaacgtttcaatgtattgcctcgaaaccttgaaggtatcaaaacacaatcttagaagctgctcttggatcgtgtacatggagctatatatcaacaggtctgcttctgtttgaagtggcttcaggggatatatgtagtcattgatagctgtctctatacttgatttccagctttcagatggaacgtcttcagcatccacatatcgtcgaacaatattgaaagctagtctcataagctttaaagataagacattcacatcgccatctttttggtacacactgtgagcaagctccattgtcttcagaattggagtaaactttttcactatgccttctgatattagttgccaattcgttgattgatatggggtagatttggttcgtaataactgatccactttacctaaccactcgttcctagtttcgatcggaagatcggccacccttctggtgtaggtatcaggatctatccaagatttgttcaggaaactgatatacttggactggtctagtaaaattctccgttctccgtcatgatggaagcccccagcttcgatctggtcataagaagcaagggcactgaactggtttgacatcacctcttctagctcgtcatccttgaaatgaatcaaatctgacacctctgccagggttatgttactgacaagtttcatatccctatgaaagtcacatattatgatttcaaatccgatctccactcgtattatcccgtctaaccttcgaccattggagtttccccacttgcagattaagttggaaccttcccactcactataattggtagcattttggagttgagctagtaaaatttgggtgtccatttcaccaccctgactttgcttggcagcagatgctcctcctaaatacaggagattattcaaaggcgctgtcgtttcaaatgtcattagagttggcggccccgtaccccaagaaggaggatgtagccccccagacgcaggaggtggatgtgaatgtgagtcatttctggggtgtttgttcgtattcttgccaaaatggataaaactatagctgaactcttcgtccatggctacccattcaaactgatcagggatttgtccgtttcgattagagtgatagagtcgagtgcccttgggaacataggctgaaaacaaactgactccgcttggatgcaacaccgaattcttctgtttcaaagcgtcgtaaacctcgttaaatacagctgaggcgttgtggatatctattggtaaataagtgggatccaacggtcgagatcccctgaacggtgcattcatgcggagttctgtagtgttccaaagtttcgatatcagcaataggcacaataacccgtttactaccagacctccatagaagctgtagatgaaccccttagaaccaagtatgagccccattacttgaaaagtggagggagtggaaaaaaagtacgtttttatcttaaagatctataaaggggcagtgccgcgatattcggatattagtaaacctaagtaatatagcacctatataacatgtctacaaaaggaatggaatcattgctttcctgttcttgggatattggtccccaaactccttgagatatcttttgtgtttcttagcggcccaaatatacatctgaatggaggcaatggtaaggaacacccaagatgaccagttattgttgagaagggcaaatgccaaccaagctacagattcaaagaaatagttggggaaagagaccaggttgaagccatatccatagggaattttatgttctctggagccatcggctctgagactggccaatttctggtgagtgatgaagttggacaattcagcaaatacccacagtccaatcagtgctagaactgtggagtcttcatggtcagatacatggaaaaaaaactgtttccaagtgggtgcaaacttatttcggtatgaatccggagcataaatagtgacagcaaggctcaatccactaagaatccaataatgagctgagttcttgaaaacgttgaaaagaggcattgtatcagatgaaaacaggtgcacaaaagttgtttcgtattcacgtttcaggaagtgcagcatcaccaaaatgaaagaaactttctgtgtaagagtgttatagtcaggtttgaaccagccgtaatagagcaatggatgaataatcagcgggcccacgtattcgatcaggaacactaatttccaactgatctggggtcccaaatctttcgcatagacttctttggaatctgaatcatctgtgaagactatcccattttgagctaaggatttctcgtagtccagagtgacatgctttggtttcttggaaactgcgtcttcttccagtttagtgaatctgattctggagctggataaactgttatttgcctttccgtaagctaccacaatgtctctgactcttgtattgggggtagtgtctacgttgatttgtctcagggtctcagaccttggattaacaatgagtttaaccattggtgatgggatgagataatgtgagagttgaccagtgtcgattcttgcgagtgaacctggttggctgggcacgacctcagttgtggaaggaaatcttagttatctacgaagggttcgcgctgacagctatccaacaaacttctccttcttggacttacactttgttctccctgttttacctctatcggccatgaagttagtaaggttcttgatgaagcttatatcggagcaagtgcaagttgaactaaagaacggaacaattgtcagcggtaccatcatctcggtgacgccgtctatgaatatcaacctgaaaaacgttaaaatgacagttagaaacagaaacccggtcagcctggagtttataaatataagaggaaacaacgttcgtatcgtgatcttgccggataatttgaatttagatagccttttgacagactcattggtcaagcctaagaataaagtggccaagaaagatccaatcagaggtggaccaagagttggcagagataaacccagaccatctgctagggctttctaagcatataagtagaagagaaaaggatcctaaggatgtaacgatcaagtcctgcctatgtacatgtatctaatataattgtaatggtcataataaattagcccaatttcaacccccaatatcatcttcctcattttctaactcgctctgtagttcactttctctagggtctagtagaccgtcatcctccagtcgcaatcggttgaccaatctgggtagtgttaacccacaaaacttctcctcagttaataactcatctaccagctgatccacgtaggtcaagtcagcgttgccgtgctttcttattcgcagttttctatagtcattcaataacggctctaacaactgataaactctcacagaagggaaaaccaaccgaatatacaacgctgccagagctgtcacatacttgaaatagggttgggtcaacatgtatatcactatctcgtctttcggctgtaactgtagcattttcagtaacagacaaatatagtcggttgctctagagttttgattggtgtcgtatgtgccaataatctccacttcacttgcaagatcttgcagttccagaatatctagtagaaagcagtgttttttccaaaacagactatctaagattttttccctgagaattttgtctatcaaaaacacagggttaactccatggatcttttcaacattctgtgccagccctctgtcaatagtgatggagtctttcacactggtcatggactgctgctgcctacgttgagtgcaatctgaaagaaagagatgaggaagtgattaaatccgcgatatccatcgatttccattcttcattatcattacatatataactacaatacattgtctaatgacctaacatgataatataattacagctgctcttcttaagcagtgtccttaagccagccctttgcctttgcaatggcattttcccacaatctccattcctttcttctgacctcgtcgctcaatgtggccttgaagtccaaagaagtgttccctgcagccaagtacatcttgttaccctcaagaatggcctcggtacattccttcaaggaaccccaaattctatcttccttagggacaccaaaaccggcagcaatggcagctcccagtgcagtacattcagggttgatggaacgtctaacagtgacacatggacccaaaatatcagcttggatctgcatcatctcgtctgatttggacatacctccgtccacggcaagaactgacagagggttgtggccagtggccttggatgattcctccaaaaagtcagcagaagctcctgcatcgctgatcatggccttcaaaatggctctagtttggaaacagacaccttccaaagcagctctagcaatatgagaagctgaggtgtattgggtcagaccgaaaatggttcctctggagttggaatcccagtaaggggcaaacaatcctgaaaatgctggaacaaataccacacctccagagttgtcaacttgagaagccaatggtccgacgtcctgagccttggaaatcaaacgaaggttatctcttaaccattgcacgacagatccagcgacagcaatcgatccctccaaagcatactgtggcttagaagagtgtttgccatcttcggactcatccaaacctgggaaccaatatcccacagtggtcaaagcaccgtgctcagaaatcaaagtctgatcaccagtgttgtacagcaagaaagcaccggtaccatatgtacatttggcatcaccctttctgacagccaactgtccaaccaaagaggcagattggtcacccagacatccagccaaaggagcaccttcaatagtttccagaagagcaagggcgtcatcagtaaggtaagactcaacatatccaatagactccaagtgtgggaccttgaagtgtccgtagacttctgcggaagatctgatttctggaaggatgactttggaagtatcgacgtcccagaatttcaaaagtctgtcgtcatatttgttggtttcaatgttcatgaagttggttctggaggcattggtaacatcagtgacgtgggatttttcgttagtcaagtggtaaatcaaccaagagtcaatagtaccaaacattagatccccatcagcattgtcataggcctgtttgacctcaggaacatgcttcagtaaccatctgaacttggttgcagaaaagtaggtggagattggacaaccacacaaggttcgcatttcctctctctccttctcagagtacttggcggtgtactcgtcaacaatatcgttgtttctggtatcgttccacacaataccgttgtaaagaggctttcctgtcttcttggaccaaacaaccgtggtctctctcatgttggcaacaccgatagatatgagcttgtatttatttttttcatctcggtccaagttcttgttctccatggtgactaaacaagcagcaagacactgaacggcgttggccaagatgtgacttggacgacattcaacccagcctggctgaggaaattgcaaagttggaccagccttattgtcaacggactcaacttccaagtcgtcagaaactgtcagggaaataccttcggaagagatgatctgagaacgctttcttttgatatcatcctgagcagaggtagagtactcgatctggtgcttggccacttcctgaccgtggtagtcaaaaagaatagctctggtggaggtagtaccaatatcgatggtagcaactagtggtgtatagtcttttcccattatagtagatatatctgtggtatagtgtgaaaaagtagaagaagagtctttttcagtccttgaaatataaaagcagcaaacgaaaagtgggcgagtattatttatataccagtatggtggaggagtcggcaaagtaccccaagtttctccccatcgaattttgctggttgaaaaaaaaacggagtgcgtgagctaacagcaaccccaacaccactgttattatcggagcacggagtacgcatctctaccagtttcaggatgcacatgcatttttatccgtgtttggagggtgtttaaggaaaaaatgtgctaactcaaacgccattgaacccagccaataaacgattctggggtgtggggagggggtgcgcaaccttaatacccccccttcggtgaaatagcgacttcaccatgaagtgctggaatactacgaggaaaacgttctttctacggcaagctctctgaagtgcgttggataagcggtggcatcttgcaagctatcagatcgggcaaacttttgacgctccgcaaccccgggaaaattaactacaagacgaataaaagaaccacctgcacctcccctcaccccttcaacaacaaaatatataatgcctttttttgctggaaggtcaatctactacacgtgataaaggtttcaggacctgttgcttcgcaccagatccaatggggtatgccgaggtcagtaccgtgtggggtcatagcagagtcggatcttattatctcaggaaggagttaatttattccgtttcttccagattgagagatttcagcaatttaacacccttcttcttctccgccccctatctcgctatcccctatttatctcgcttaataaatgtttaaccagggcaattccccgaagttgtttacctttcggtatgacgttatccccaatttcgatttcaaagaacaatgccacttaaaatcaaggcaacactattgttagtttcccccataaaatcaagagaatgcaggctgctaaattgggtcacttgaaagttggggtccgacttgaaacagtcaggagcggagtattggattagtaaagttaccgattcttccgtgccaacaaatctcccaaaatagaaaataccgagcaattctttcccggccttgcaggtgtttgctgtaggatgacctagatttttccgtgtttgattccgtccatgcatctcaagttatttcccaccggctagcaaaggtccatttctcggaaccaaaaattcgggaagaaaaagtctggagagctaagctggtgaaagttgccatatttttttataaattgatcaacgacgcaaatatttggtctactcttttcgcctaaatcgggatagtaaaccttttcatgtcatattcaaaaccacaaatccaagagactgaagactcggcccacagtatagaaaagccatttctgggttcctccaaccaagaaccagatttctctgcaattgaagaagagctccctgagatcaacaactggcttgctaaggtcagatatgagtacagagactacttagctgagttcattggaaccctagtgttggttggattcggtgacggtgttgttgctcagaaagtcacatctggtggcactgctggtaactatacgactatcgttctttcatggggtattgcagtcaccttcggttttatggcatctggaggtgtctccggaggtcacttgaaccctgctgtcactctttgcgctgccatttttaggggattcccctggaggaaagtccccggttacatgttctctcagatgctaggaggtttcatgggtgctttcgtcgtttacggtacttacattcaagctatcgctcatttcgaagggggaacccaaagaactgttttcggagagaatgccacagcaggaatcttctgtacatatgcgcaaccatacctgcacaccaaacatcaagttgtttctgaacttgtggcttctgcgttcctgcagtttggaatcttttctttaacagatacctctaatgtgtcatcgtcaccattttggttcccatttggtttatttttactgattgtcggaattggttcatctttcggataccagacgggttatgccatcaacgcagcaagagatcttgcccctcgtattgcatccagagccctaggttacggtccagagacatttactgcatatcacaactacgcttgggtccctgctgttattcccttcatcggctgtattttgggagggttcctttacgacttgttcgtctttactggatcagtttcccctcttaataagccttatttcggtttcggcaagtttttcaacaagaagtccaaggctccaactattgcctagacggcactagtgagaatggggcaatagaaaaaaacccatacatcacattgactagtcatttttacttagtgtatactagatataataataaagctacgatcatcacagtgaaatatctttgatggtcggtcagtattaatcttgtcacatgacctacttccgtcttcccatgactccctcctaaggttgtgtgcgctggtgcgtcaggttcggtccccgggaggagtctcgaccaatggctaggtagtgataacaatcaaagtttatgagaccagtagtttgacacatagtgcatttattggaaatatggggacactaccttccgccaataggagacgagaatacgactagacgtatctcgtaaagtccctccgcctcgatctagaactgccaccatatttgaggatcaaagaccagaagaagtgtcgtgccagtttttcagataaatcattcgccgagatcagtcgatcatcagcgttcagtccatgagaacaaggtgctggcttgacgtatcttcaggcagccagcagctttttgtttcagcctatcatctttgaggcttatcatcttactgataagactatgggaaaaaacccaagaaaatgagatgttttatgtgaacgaccatttacttttttagataggcaatcttctgccccggtgagtctcctcattgggcaatgttgtaattacacgactaacaaatcagaggcggtaaacgctagtctcggcagcgtcatcgaggtcagtgcatactcaacaatagaaggcgcgcaatcattagacaacttgatccatagcccgcagcgtttcttctccagaaagttcactataattacccgtagaggattggttcaacatacaagaagatcagcaaatcaccttcagtattcggcgacaagatttatttttcactgaggtttcaaagcttttcaaatttcaatataatacttccctattaatcatgcatgcaccctacaagatttcgcatttcgtttttttactacaggaattactgaccaggtgactctaaaatagctttgaggtatataaatcacaaaggcgctgttagcagacagtttttttcttttcgtttcttaccttcggtcaacaatattaattcgcttcaagctacttagttctctccattataagagaatcttaatataaacacctatacattacaattacaatatgtcttcatccgaaatcattgaaaacactgctttgctgcagaaatatcagtccttagaccagagaggtaagatcattgccgagtacatctggattgatgccagtggaggaatcagatccaagggtagaaccttgagcaagaagccttcttccattgatgaccttccagaatggaacttcgacggttcttccactggacaggctccaggtcacgactctgacgtctacctgagaccagtctcctactacgccgaccctttcagaagaggtgacaacattgttgttctggccgagtgctggaacaacgatggtactccaaacaagttcaaccacagacatgagtgtgccaagctgatgaaggcccacaaggaccaggaggtttggttcggtctggaacaggagtacaccctgctcgacaagtatgacaatgtctacgcttggccaaagggcggtttcccagctcctcagggtccatactactgtggtgttggtaccggtaaggtctacgctagagacatgattgaagctcattacagagcttgtattcacgccggaattaacatctccggtatcaatgctgaggtcatgccttcccagtgggagttccaggtcggtccttgcaatggtatcgacatgggagaccagctctgggttgcccgttacctgttgcagcgtgttgccgaggagttcggtatcaagatctcattccatcctaagccactgaagggtgactggaatggtgctggttgccataccaatgtttcgacttccgccatgagagttccaggtggtatgaaatacattgaggccgctgtcgagaagctggccaagagacatttggagcacattgctctatatggttctgacaacgaacagagattgactggaagacatgaaactgcttccatgacttctttctcttccggtgtcgccaacagaggtgcttctatcagaattccaagatctgttgccaaggagggatacggttactttgaggaccgtagacctgcttccaacattgatccatacttggtcactggtatcatggttgagaccatctgtggtgccatccctgatgctgacatgaccaaggagtacaagagagaatctgattaaatagtatatcagcagctcatatctagtacttcctagcttgaagtataaaaagaaatgcctgttaagttttgtaagccaagaaatttacgttttttagttctaaaagttcccgctgtattctttacataagagattcatgatccatcagccataataaattttaaatatgtaatactacaaacgtattaagctgccaaaccgatgacaccacaagctggtcttccaccagcgttaccggtcttcaaagagtcggcgtgaccaccctttcctagatcgtcagttccgtcgtgaataacaacagttctacctagaattgaggtctcaccgatcagcttaacctggttatcggttataacacccttggcaacaccttcagcgtcggtcttgacgttacccaagtcaccgacgtgtctagcttcgtcagttggagcaccgtgggtcttaccaaatgggttgaagtgaggaccagctgaagtacaaccattggtattgtcaccgaactggtgaatgtggaaacctctctcagcgtttggggagttacctttgatgtcgtaagtgatagtggtagggctgctttcggaggattgttcgaagacaacggtaccgccgacggtagaatcgcctcttaagactgcaactgctttgaccatttttgtgtagatgttaaatagggaagaaacacagaaaataaagaattcgaaaggtatatgaggggcagctttcttttatagtttgcggtcggttctagaaaataactcccccttttttcgccactgctagtcgagaacactaataatgactaagcgtcatatcaattactgtatatgaacaaagaagaagatgccaattgagtcaaattatgagtaaaaaacataattgaatgaggatttcaaggaacctggggggaaagggccccttttatagtgtctcaaaagctctttgaccctgttggtggtgaaattgtagttatttactcgtttttttgctcgttttgcgtttgccgttttcatgcattgctctttctgcaagcgaaagcgatctcacgtggacaaaagtgtgctcgttgatcaatgattggtttggtggcaggagctgagttgacgagaccctgtctattcctcaaacccaatgaagccaccactgtgtgacgagtgcctagaaaagtaatcaaagtcaattgaaacggcattggctaataatacagccctttggtccagcgtaagggcatgttgggccacattgttcccgtagttcccttctagccctacaaaagattcaggccccatacggatgatgtaaactcctgtatctgtgaaaagctctcttgcaaagcccacgaagtttctagagacagcacctagcgtttgcctagattctgaaagtacaggaaactcaaaggaaagaaacggtgcgtcaatgtacccgaactgatcgtagacagtgtccttttcgccaatttgtgctgtaaatagattgtatcttcgtctccaaggatgccagctttgaacggattctccaattacatgttcgtctgggtcgctgttcctgaaagggggtaatatagctttgatgtgcgaattgatgaaactaaacggcctcttgattgtcattaatacatttcctgcagtatccattacatccactgtaaaaggtcgatgcaaacggtagatctgtctcaatatagctttggtgatgcccagatccctttctagcatgtaacccaaaatacttcctgtaggatccatgataacatatcggttcgcctgctcaaatcctaaaaatatattcatcatttccatttgccgttctatgaccagagttggttgtctcagaatgtttgcaattgagtcggatgggagtattactccttgctcattagtaactggttgttggtcccatctagtggcgtcaaactgatggggttgaggcgcctgagcatgcctacgataattctttagagaatcgtagttgagaggggtataactccttttgaaagagtacttcggaacgcaattagccaatctcaagcctctccttaaaagcattctcagtcttattcctgatgcgattagactaatctgagaggtagaagctcagaaggaagttccgcacggaggagcacgcgaaaaaagtatctccccaagagaaaccattcacctctgtatttccgtgcgcctaagaaaattccactcagaagcccacaagacaaatttttcgatcgttcagacgagaataagatttgaacatcatccagtgccatgtttctaaagtccgtacaaaggagtaccagaggaatccatacggtaccaaaactagccaaccaggatgcgtggctgaaaaatgggataaaaggactctactctgcccagggatttaaggaatcctgggtcgactaccaacaatatctagtagataatcttaccatgagaactgtgggaacccttaacgaaacacgcacgccctttgaaatcatcaaggccacatacaaaaatgcatctgatacaacaaccttccactatgcttcacaatgtttcaacaaccatctgttttttgaacaagtggctgactccggggcctctgactcggcaccttcaccaaatttagagtacattataaataaatcatttggatctctagaggacttgaaggctgattttgaggctgagcttaccacactgaatggtcaaggctgggttttcttggtagagaacaaccagaaagaactcgaaattgtttcatgtatcaatgagggaacgccctattttcacagcagaaaccagaatctggatctctcttcgcaaatcactattgatgatgtcacacaactggatatcttgtcacaatttgtcaagaacggaaacagagagccattcaataacgttcctttaatctgtttcaactcatggcactatgcatacctacatgactatggtgttaacggcaaggttgagtttttgcaaaagttctgggattgtctgaactggaatgtcatcaaccaaagactcttcaaccaagccagcctttgaacctattcctataaactgtaaatagaatgaataataaagcgctaaaacttgtgtcatattctttccaatatttgtgagagtctttcattcttactccagtctagtccagagctggcaatcagaccgtataaaatatctttcagacgattctcgtcttcgctctcctgatctggcagctcctgtggtgtacatggtgtacgtgttggcacagacggagtatctttcgattttatcaggccatcagagttcaaaatggatatcgtctgctcatcacactttgctatcaattctttcatctcttcgtcgttgggactagtctcttccccataaaaggcgttcatactgggataggatattagtttttgttcgatgatgcttcttctaacgctgagcatttgtcggagctgcttgttaagtttttgtattgattcaatttgctgttctacgtccgcatggagatttaggtccgcgtgtagggagaattctgataaagacttcactacttcctgaaactcagactctataacgctgttgggttgactcgaggtgttttttcgttccaattcgatatgagcttcatctgataatctgaccagttctctataagtatttgcgtggtccatttattggagagtttgatgtgaaaagtaagcaaatattcaaaacacctaccgttgataggcaggtaaaactaacctgaaggagtactaacccgcgactccttctaaccatcacaatgtatttctttgaatcatgatccatctctgaacatgtcgtcattcgaattcccttctatttacaactttcccccttttttcactaagcagcccaataattctgtttggaagagtcaacttcaacaatggaccactttagttctggactattgcaaacattataggatatggagattatccactgcaggcacaccgatagtggaggatgcaaccggggtaccatccgattctctgttcacaaactccataatcgatcgtcatttgaaacctgaagtttgtcaagaaatcattgcttcgttggttgatcagggcagagctcaatggattgataagactgctcagaaatctgtattggtgctttggtattctatctccgaatggagtgatcttttactgaactgggttgattccacgggtcaaaaaggcgtagttttaacattgtacgagattcaacacggcaacttgactctatctgaggagttccattcaattgacgagacaacgctcacccaagcgctggagctcttggagaaaaaaggaaaagttctaatgatgaaggaaaacaagaatgtggttggtgttaagttcatatagcaagatgattcagaaaggctcacgcatcttagagagctcatttgaggggagaggatagtagcatctccagtttaaggtatcaaatattgaactccggacagaaacaaacatagtaacattcatcaccgtcaacccactacccctctaaatagaaacgttaaatcaatctatctctgcaatatactccactacaagtcaggttgtgccaccttcagacccactacgtggacctcatacgcaccctatgtctatgcctttagaacgaccgcgaaacgcgttaccttaccagaaaaaaaattttacgttcctcttcttctttccccttcattagagtactatcttgggggctaccttttcatagttacaggctttaaagttcaatatacaggcagaagagaaaatgaaatacgtggttgtatctggaggtgtcatttccggtattggtaaaggagtgttggcttcttctactggtcttcttttgaaaacattaggtcttagagtcacttctatcaagattgacccttacatgaacattgacgctggtacaatgtctcccctggagcatggagaatgctttgtcctgaacgatggtggtgaagtcgatttggatctcggaaactacgaaagatatctcaatatcaccctaaccagagatcacaacattaccactggtaaggtctattcaaaggttatcgaaaaggaaagaaacggtgactatctcggaaaaactgtccaggttgtccctcacttaaccaatgcgattcaggactggattgaaagagtcgctagaattcctgttgacaagtcgggccaacaaccggatgtgtgtattattgaactaggtggtaccgttggtgatattgagagtgctccatttgttgaagctcttagacagttccagtttcgtgtaggaagagacaattttgctctgattcatgtgtccttggtacctgtcatccacggtgagcaaaaaaccaagccaacacaggcagctatcaaggatcttagatcattgggattaagccctgacatgattgcttgcagatgttcttccacactagatactgctaccgttgagaaaattgctatgttctgtcatgttggacctgaacaagttttggctgttcatgatgtcaactccacttatcacgtcccccttttgttaagagaacagaagcagatggactttttgactgacagattgaagttgaaatcgctcaatctttcgtctgaaatgaagaccaagggtgctgagttactctccaggtggagttctgttacgacctctcacgataggtcttttgaaactgtatccattgcaattgtgggtaaatacactaacctacatgattcttatttgtcagtcatcaaagctttagagcactctgccatgagatgcgaaagaaaactggagattgtgtgggttgaatcttctaatttggagtctgactctcaggaaaccaacaaggcagactttcacaaggcttggcactcactttgttgtgctgatggtatcttggttcctggaggatttggttccagaggtatagaaggtatggtccttgctgcaaaatgggctagagagaataatatcccatacctcggtatttgcttgggtcttcagattgctgtcatggactttgtaagacatgtgctaggaattgagggttctaattcccaagaaagtgacccagagtacccagaagagaaagcctcagtagtttatatgccagatgtggatcaagaaaaactcggtggtactatgagattgggtcttcacagcactcacttcagggaaggtacggaatggtcctctctaagaaagctctatggtggtgcaaacatagtcaatgaaagacacagacacagatacgaagtgaaccccaaattagtcgatgatatcgaagcaaaaggtcttcaattcattggccgtgacgaatccggaaatagaatggaaattctagagcttcaaagccacccttattttgtgggaacacagtatcatccagaatatctttcaaaggtgctggatccttcaaagcctatacttgggttggttgccgcagcttctggaatcctaagcgatgttattgagaacaaatctcaattgtacgagggtgatttctaaccagttgaaggaagggatagtatagaaatagtaattaatatgcatattatatgaaaaccgttgtatttacggttttgtgtgacgtttctttcgcttagctaaaaaatacgctgtccatcttaacactttacctaggttagcatattgtccgctgtctcgttgaactctttatcgttatcttagctatggaagaaactttggatcaactgatttgtgatctggatcagttccgtttacaaaaaattcaaaatgaatccatgttcaaacagctaaactctaatgataaaaatgtcttgaacttaattcaaacaaataactcagagttatcggtccaaaagtacaacggactgtcttgtgttatgtctgaacttggaagtaacagacagaatatcataaagttaaacttagaccatctggataacatttttaatttaaaatcgctaagtgaagaagtggactctctaaggttacgatatcaaagagttcttcggcagcattttcctgaagtcagtgaaactgggtgcttcgatgatactagtatcaaatcacttgaacacacaaaggatttgggaagagaatcggatataaaatatctcttgagcggaagattgactcaggaccaagtgggcttgcaagttacgcttgaagaccaaatggacaaggaagaagcaaacttgacgagggaacatttcaaacaaattgagttgtgcattataaaccaggttgaaaaattgctcaccacgcttgatcagtgtcgggatcccgataagataaagatcaacaggctgaaaaattcagtaattgacacgtcttgcacgttcattgagtacatccagtcacatgtagacgatgccaagtattacccctcgttctataataatctagctcagttgagccgaataaaatctagaatatctttggagtatggagaattgaaaaattgtgtcctcacagaaacgcaattacaacaactcgaatcaaagtcttggggtattctgattaaatgtttacaagtcacactcaaggacaccgatttggaacaaaaagggtcagaacttcgtcttacagcctcgcaagcccgagtgttgggtcaagcgtatgcacaaatggcgcatatactgctggagagagcgtcccggaccatgaagcagcaatcgacagccaactacccgtacttagactcaattttgaccctggcaagctatctcttatatctttcgggcaattttgggaacattgtttccaaagttgtcagtatcaatgtgaacccatatgccaaactatgccagggggtgttcagagagtcgttgctgagagaaatgactgatgtttatatcaattcatgtgagtccagagaaaaggttccaaccacttgcctcatggacggtggatgaaaactaaagtacagaatgtgttgtattcttcaccttctcgtagttccgactcaatatgttgcgtaatttcgatatctattacataatcagcatctaatggttatcccttatcgcgtattaatctgaggagaagattataaaaggttgctctagcccactttctgccctttcctcttactctattgaattccgtcatgtcagaaaaaaaatcatttattgtaagctagtcacatatcgtcgttcaattcaattgtgaatcctgtaatattaactttaagattactttgaaagaagatgccacagaccccgccattgagaagtatgcttagttaaattgagatcccaacagaaaattggtgtactaacaactcaatttagagtcaaatctttcatcaagtcaattgggggtgaaatatctcatgagttcagtttgatcaagggatttaggtaagtaccaccatccactagaaaaatattgcaagagcgccactgaccagcaattaagtgccaaactgcccactacccacgtttcaagtgttgaaggtgacgaagctgttgctactattgaagaagacagtgaagttcacattcaaaagtagatccttaagcataataaaatagaacggaaattaatccctgttcattgtgtctttaaataactaaactttttttatttctagagccctatccagcgtatttttgtaccttgtctcttttactgccagtctttaaggagtgtttcatcattgtttgtccggttgatcccggccattttggccctattgtagggagatcttcaacgtgctacgatttctccacaatccgcgatacaaggttattggtagcactaatcgttctatcgctccactatagaacaataccgatgaccgactacagccaactaaacaagaacccaatcttcaaaccagtagattcaatttacacagataggcttcgaaagttcaatgacaatgaccacttagggaaattcagagtaagacatcgcattgacaactccaaagatgatggctcagacggttatgttgaattgaaaaagtactctgtaccagacctccagagaccgtccttcaaggaaattattccatcaaaactggacgagtttgaaccctgtcatagaaatgacctttttggccccgggtgggcttcgttctggatccaagtcaagattgcggtgccaacgtattggaaagagcactatggcaatggcaagaaagacccaattgccttccattgggactcagataatgagatattgatttatgaccatgaaggaattccccaacagtctttgactggaggtggccataggacagaattcattcttccctccgattggtatgaagacagggatgaatatgtcttctacttggaaatggcctgtaatggcctatttggtacgactccatcgttttactatacacttcatactgcagaattaattgttaaaaattctgaggcggactctctttattacgatttctggatcatgggagacgcagcacgagagttaccaggagactcgccccaaaagtacctggcacttcaattgtgcaacaagattatggacacttttgatgtcaatgacgaaaaatctttggctaaatgcagagaagtggcaaagcaatatctagggcctgatatcaatggctcagaagtattcgatgattccacgacaccctttcccatccaagtgtatgccatgggaaattgccacattgataccgcctggctgtggccttttgctgagacaaaaaggaaagtggttagatcttggactacccaaatcaggataatggagaagtatcccgagtatcagtttgtcgcttcgcaaggtcaacagttcaagtggctgagagatctccatcctgaaatctttactcaaatcaagaaaaagcttaaagacaaccagttttttcccattggtggatcttgggtagagaatgacactaacatgccaagtggtgaatccttgattaggcagtttcttagaggccaaagactgttattaaacgagttcggtttcaagtccaaaaccttctggctgccggacacctttggttactcttcacaaatcccgcagatctgtcgagtggtagggatcgaaaacttcttaactcagaaattatcatggaacaatatcaacaaatttccccagaatactttcaactgggtaggaattgatggatcccaagtcttgactcacatgcctcctgacaatacttacacggctccagctcattttggtgatgtcaatagaaccataacacaacacaaaaatctttacaacgatcaaaaaggtcttttgctgtacggtcatggagatggaggatcaggtgccacaccagaaatgcttgaaaagctccgtcgatgtagaggtatgacgaatactgtgggatcatctcttcccgttacaaaagttggtaattttacaattgaggagttttatgacaaaatcagaaaggattcagacaatgcaaaaactctgccaagctggaagggagagctatatttggagtatcatagaggaacgtatactacgcaagcaaaggtgaagcagtatatgagaactcttgaatcactgatgcatgatctagagttgatcgcaacttatgtgtccttgaaccatgtcagctacgtctaccctttgaagaaaattaacagaatatgggaagatattcttctttgccagttccacgatgtcttaccaggatcatgcatcgagattgtttacaaggaagaagtcctcccaatgctgggtaaaagggtggatgatctgcgtgagcttattgatgaagctttgggaaaagttggtgtcagatactgtggaactaacgagaaaccaatgttattgaataccttcagctggcctaggagtactattcatgatattgcaggcactcctgtcttattcaactctattgaacaaaacttgaacatgtgtatcataaaaaagaaggtcaagtatcctgtatcagttaccagggacgaagatgattacattctagataactcgaaactcaaagttcgagtcaacaagaagggaattattaccagtctttatgatattgtcaacgacagggaagttattgatatttcaccagaaggtagaaatactcgtggagccaacgcttttgtgctctttgatgatgaaccgttaaattttgatggctgggatactgaactatacaatgtcaacacatttaggtatgttgacgatgttatttccagtgaacttgttgaggaagggccgttaaaagtctctatcagcttcaaacaccggattagtggctctagtcaattgaagaatgtaatctcattggaaggcagtgatgatttggaatcagtttccctagtgaagtttgagacatttgtggattggaataagtcacacaagtttttaaaggtcgagtttccagttgacattaaccaagaatacgctagttacgaaacgcaatttgggatcaccaggcgaccgactcacttcaatacaacttgggatacagcaaaatttgaagtttgctcccatcggtttgctgactattcagactttaattatggtgtatctatcatcaatgattcaaagtatggatttgctgttcatgggaatttaatgaggttatcgttgttaagagcgccaaaatatccggatgcgcatgctgatattggtaagcattacttcaactatgctatttatccccacaaaggaccgctttcctcacagactgtgaaattaggtttggaatttaatgacagacttaatgagcaggcatacaccttcacggggtcccctatagactttacggaattggtgaagataaaaggtgatgataatttgatcttaagcaacgtcaaaagaggtgaagacgatgatgatttggagaactgggaacccaacttgcccaagaagcacaagaagagcattgtgatcagagtatatgaggctctgggaggtgcatccaaagctgtcattcgggtgggaaaacctatacaaaaagttaccaagattaccggactagaggaagacctgaaagatgttgactttgacaaggagactaactcgttcaaagtgaaatctagagcttttgaaatatccagtttcaaaattgtccttaagtagtcagttacattttcgttcgcgttcacattgaaaccctgatagaataaactctgtagtctaattattccatgtctctggatgcttccaaacacgtcaagtactttcaactatgccttgatatgttgccttcaaggtttgaggaggaggactcaaataagctggcaatagtgtacttttctctgttggggttgttgttattacgagacaaacaatctgaagacatcgttaatatcaatcgagaagagaagattgaatggatttataagcattatctgcctgataaatcaggttttagaggaagtcttctgtatgatctacagttgaatcagccaaaggacagcaccaatagtaatgaatatgatgtgcctaatatggccgcaacgttgtttagtcttcaaattctttacatgttcaaagataaaagaatcatggacagactggataaaaataggataatgagtttcgtctcccaatgtcaaactgaagatgggtcgtttaaatcttgtttaggccgagacggaattgcatttggtgattcggatcttaggcattgtatgatagcttgcacgatacggaggattttatctggttgtgaaactacaacttttcaggacgatattaatgtagaaaagttgaaagatcatataatgcaatgtctgaactacaatggaggacttggaggttcgcctaacgaagaaagccatgcaggtctgacattttgtggattggcatcgctcaaactacttggtgcagagttaaatccgaacgaatggagaaataccatcagatggctttgtcacaggcagatacaatcccagtccggtgacgataacaacggtggctttaatggtagagaaaacaaatccgctgatacatgctattctttctgggtaattggatcgctgaaattattcaatatggagcatctaatcgaccaaaaacaaatcaagcaatacctaatcacagtgactcaaaataaatttatgggcggatttactaagaccagtgaggttaagatatcggacccgctacacagttctttggcattatgcacattaagcattttagggttcccaggtttggctcagttggatctagtaaccatgacacccttataaactgacactaacgtctcatgagatagaaatttatatctatactatatacagttgagcaattgaactgcttgtttaaaaagtggaagctactttgattagctcttcgtagatacaccaggcgataccagcggaaccagcttttcttattagtctcaaagaaagcccattgaacattcttgaaacaccttcatttctcactaacgaaatacctgttccccataatgttgggtatttttgagggtagagctgcatgcaagttttaattgtgtcaaatggagcagtgatgatagttgaaagtgaggccgaaagggtggccgacatggagttaattaatgcagacttggaagaagagtatacagacttatcgcttgggtccccccgatctattaatttcggcaaccaagacttgaagtgttcgtagaacaggacatagagcccagcatttggtgcgtctcttgctgtggtagcccaaaacccgttgaagaaccctctaggaccctcccgcgtaagtatatccttgaaggccatacccatgctggagtagttatatgatacggactcgtatctgaccttaatgacggtgactggcatagtaacaaatcctataactgaccttgcgaacataccggtaatgaggttttcactagaggaaagttttggtagcctgctacttcggttcatagaaacagtttgtgccttctgttcggcaacaaaagttctggtaatattcaaaaatgtgaggtaaagagcacttcctactgatgttctgacaccagacggtatagtccctctccataaatctgtgacatgagatattctcttcaattcactggttatagtggcattcttagtttgttgaaccctcgtcttcaataagtctaatggttgaagacaaattgatgaagtcaaccctcctacaaatccagccacaagatgcgtggatgaggtattggagttattggacatgttggagggttggaaagaaggccgagtgtgttaacctgggcagagggcagattccggggggagatatgcactttacaaaaaattctcgacgggaagaaatgacttctgattgattgctaagaccggatgttgacaccgtttcttagttctacttctactagtttacaatggtctatatataatgctattttgagtccactaagctaaatgctgtttctcttagcatagtcaatgattagtttttcactcatttgtacaacaatcggtttggtatctgcaatgacactagagataattctggaggttagcttgcatacataagccggttctgttccttgataataattccaatcaaggtctagtttgcgaagataatctctggatagaccagctctttcttcttcgtttaggattttatcgctatgcaacaccgaaatattcctgtaaacccattgatctagtggttgatgcaatcctatcccgtgatacttagagcagctctcttttagagcccaatactgtgttagaatttcaaattgtctatcttctgtgtgtcgaggaagttcacgttcaagaaagttcgtttcgtctgggtgaaaaatatcagaaaaggatcgtaaaagctgtattgggtcctcttgaaactgtttgattgtttgtatatcagccaaatcgattcctaattgcttaatcgaaggtttttcagactcacttcccagtttttgtgcatcttttcttcgaaagacaattcctactacagattcatcgtctgccatattatattccaattgttttatagatggcttgccacacggtgccacagttatctcaggttcaaacagggtgtccatctcatagtttaaggacagaattgttcttagcaacaagcctcctagtaaggccatcctctgatcatgtctattctttctcgctaggattctgttacgctgtttcaacgacaattgacgtaaacacagttccattaaataatcatcttctaactcgttgccgactttgaccactacaagaatatttctttctccttctgtcaactgcttccaatgttgaaagacatcgtccattcttcaacgaagaagtttattagaacagtattacctaatctgagaagttcaaggcgacgtgtactgatccatatggtcccatcatcactgcatgatattctggattcttaggctatcggagtcgtgtatctaccagaactttatcacaagccaagcggagaagatcatatttaaggcccatcttccccaacctcgagtagtgtttgttgttgtgccatctgttatcaagccgtccgaaatgtccagtatacgtgaagaaatggtgacttcggcagtggagtttctaaagaacccacagattgccgattcgcctcttgcaaaaaagatcgaattcattgaaagcaaaggcttgaatgaagccgaggttaaggaggcattgctgagatcacagggtggtaatggttcgtcctcagttgcctcccaagtgtcatcgtattctccctcagcatctcagtctagtgtagcgccatctcctcctccttttcctgatcattatagaaatgccccgccattgcccgaaagagactggaaagattattttgtaatggctacagctactgccggtgtttcgtttgggctttataaagtcatcagcaactacgttttaccaaaacttctgcccccttcgaaggaagctattgagttggataaagaagctattgatcgtgaatttactcgcgtggaagctctgctcaacacgtttgaagaagaccaaaaagcgttttatgaggaacaaagagagaagagcggcaagattgaagatactctgactgaaattgatgcaataatttccaaaactaacgagaagaatttaaataacgaggaatccttgaagtatttaaagctggagattgagagcataaagaatacgttgatgaaaaacattgattcgcaaaagtctaccatttccagtgaacttggtagtattgaagcccaattagatgaattaaagaaactcattgtagcgaaacctgaagatgaacccatccgagcagctccccagccgtcattaacaaccggcgctaatagcttaacctccgaaagctctggtaggtcttcaattcctcacagccagtctgtaccaataaggacacaactcacaactcctccatcggactctgacacatctggtcctgccaaattgcacattccgccagcaacatcgatcccatcattaaaggacattttgagaaaagaaaagaatagaaccgtcgatactttttcaaagagtaatctaggtaaggacctggaaagcgtggctcagtccgatccagataaagttgagaagtacgaaggccgcagagatcttaaaagtttggagcgtcccgaggaggacgagaaaaaggaggacgacgttgaagatggaggggataaggacaaactggcttcttccctggagtccgtcaagcttcctccaagctccgagcaggtacaagcaccagctccaaaagagaggacatcgagtagttcttctagaagcggtataccagcttggcagttggcagctcaaagctgagttgtcatgattaataattttgtatttatgtatcgctgttgatcaacggtaatagaaagttacttacttgagaagctcagcttctgggcgcattatgcattgaaatttaccgaggaggcagtatctagatgacaaggattcataagcatccagacaaaatcagattctgtaacgaggcggatatatcatggaaatgaactgaatcaagtgtgttatgaaattaccccactaaatctgagttttctcacacagatttagtgtcgatgcgaatagccagatcagtattattgaatctggctagacttggacgacatttgagcaaaatgaagtgtaaggttctgtgcatttgaaaccatgatcagctagagcaaactaaaactagcaaatacagacagtgaacagaggccaaaaagtcctctacattacctgggcgactgagctgaaaactgaatctttctcacttcgcttatcttcaagtgagattttacttttttcattgtgtcacaattttttttctccattttttttccctgaaggtattagtcatcctacacagcgaccatgaaccaactgaatatcagaggtttggcccagagaagtagagccaagttgttcagccgatcatttgcttcaactgcaatttctcgaggtcaaaatttgactgaaaaaattgttcaaaagtacgccgtgggacttcctgaaggtaaatttgtccatagtggagactatgtgacaatcaagcctgcacatgtgatgtcccacgataattcatggcctgttgctctgaaattcaagggtctgggtgcatcaaaggtgttcgacaaccgtcagatcgttaacaccttggatcatgatgtgcaaaacaaatctgaaaaaaatttggaaaaatacgagaacatcaagaactttgccaaggaacaaggaattgatttctatccagctgggagaggtatcgggcaccagatcatgatcgaagaaggttacgctttccctctaaacgtaactgttgcatcagactcgcattcgaatacctatggtggtattggggctcttggaactcctgttgttcggacggatgccgcttctatctgggctacaggtcagacgtggtggcaggttcctcccgttgccaaagtggagctcaagggaaagcttcccaaaggtgtcactgggaaagatgtcattgtgtctctttgtggattattcaacaatgatgaggtcttgaaccacgctattgaattcgttggagaagaaattgaaaatcttccagttgactatagactcaccattgccaatatgaccaccgaatggggtgctctctctggtcttttccctgttgatgacactctgatcagatggtacacgaatagaatgatcaagttagggcctggccatccccgtatcaatgaagagactttgtccgatttgattaccaacaagatggatgctgaccccgatgcttactacgccaaaaccttaacagtagacctctccaccatgtctccgtacatatccggaccaaactctgtaaagatttctaattctctggaggatctgtccaacaagaacatgaagataaacaaggcctatttggtctcatgtaccaattccagactgtccgacataagggctgctgctgatgttatcaagggtaagaaagttgctcctggtgtcgagttttacattgcagccgcctccagtgaagttcagaaagaggctgaatctgatggttcgtggaattcattgatcgatgccggtgctattactttaccggcaggttgtggtccctgtattggtctaggaactggtttgttggaagaaggcgaagttggtatttccgctaccaacagaaacttcaaaggtagaatggggtcaaaggatgcgctcgcattcttggcttccccagaagttgttgcagcatctgcagtgatgggtaagattgctggaccagaagaagttgagggaaacccagtaaaacgtgtcagagaccttaaaaagagcataattattcacgaacctgaacaatcggaatctgcaggaggagctgtggaagttcttgctggtttccccgagtcgattgaaggtgagctaattctctgtgatgctgataacatcaatactgacggtatctatccaggaaaatacacttaccaggacgatgtttctcgtgaaaaaatggccgaagtctgtatggagaattacgacccagaattcggaagcaaaaccaaaccgggcgatattattgtgtcaggttataactttggaacagggtcttcaagagagcaagcggctaccgcaatcttagccagagacatgaagttgattgtggcaggttcctttggtaatattttttccagaaattccattaacaacgccttactgactcttgagatccctaagttaatcaacatgctaagagaaaagtattccagtaacgaggagaaggaattgacccgaagaactggatggttcctcaaatgggatgtcaaagccgctaccgtgactgttactgacggcaagagtggagaagttgtcttgaaacaaaaagttggagaattgggaaccaatctgcaagatatcattattaaaggcggtcttgaaggttgggtcaaggccaaactggccgaaaccagtacgtagagtgacattgtcacaatatatttatttatttattgatagaatagaaattcctgtatctacctactaatatacagagtgtttactaaaccgtccttccctctttttctctcacttacaacgagccaacttccttgactacctcgtcgaaagaatctttgtactcttcggctgttttgctttctcccttcttgctcttgttagcatttggaacgatcatgacacaagaagttgggcgcttggtagctccagcagatcccagatcctccttagaaggtaagaacaaatatggaacgttactatcctcacataaaactggaatatgagaaataacatctggtggtgaaatgtcacctgcaatgatcactaaccctttctctccctttcttaaggatttcacgacctctttaacacctcttctcacatgcttggctttggaagccttcttgacagttttgagaacctttttgttaagctttttagaggctaaaggtttagcaaaaggcaaaagtgcaggcaacttcttgtcgtagttgtcttcagtttcctccttactggcgctcttctctttttttgacattgtttgatagttgaattatcggaaactaaaaaaaaatttcaactataccagcttacaaaaaaaaatttagcactgagaacttggtcgtgtccactctattttactagatatttgtatcaagcttaagtaataatttgaactaaggtcgtgcattcacaactttgctttactatctcagaaagcactacttcacttcaggaagagacataaggtgaacatgtcttcaaagaaggactcttccaagagaatgtccctcttcggaccgctgaagggtaccggaatacttggatttggtcacaatgacactaaacagcagcatggccacaaaaagactctttcggactcaaataccaaaaggaaacagactattctcctaccagatgaccgactccacagttcagacgtttcaagggcttcttctaatactatttctgatttaccacttccgaacgctcccaagacgaatctttcactctcgcctgattttgcgagatccttttcacctcctcgtatggttgattcgcagtttcatccgtctgtgatgaatggtcaacaactccaagctgaagtatcgacagaggaatttaactttcattcctcgcacatagctcctgccaagtctctaacacggagacgacctccgcccagagatccgtcgccagtaaaggatcagttgaatcatggttcaaatgctgaggttcttcaagagaagatcactgtcaaggaaagcaatgacaccggcgcagaaaaagaactggaaagggtcaacaattctgaagcttctactcaggtcaacaatattgttgaaggagaagactcgggttttacgcctgagactaactattccaccggtgtaactaatgatgtaaatgatatttccacaaatttgaagttaaacacaacagcagccgttagctcttccagtaataaatcgatctcatcaacaccattaaacaaaattatctcatctttagaaaatgagctcaacgagatgagagataatgatgcaagttcaacaagtcttggtcagtatagctcttccttttcacagcaatcttcagtgtattcacctctcaattttaatggtagaagggcaactagtgacgaaaggaagtccttagattcaagtatctattcttctcataccgaaaattcgcagcaatctcacacgtccctcttaagaaatgagatcaatgcgctgctaatatctgacgatatcaaccacgaaatacaacaaaaaacgtacactgagaacaataatgacgaagatttgacagacaacgaggagtcttacaagaagggccatacaagggctgcgcccagtgatgctacggtgaaagtgtttgacatacctagtgttaatgtgcagaacgaaattgaagaggaggttgtggcaattccgagggaaaaagcaggcaccactgacatccatgccctattgaatgatggaaccatttcacccccagtttttgttcctcctcatgttgattcatcccctagaagttcatgcactagtggtcagagtggagaaattttctatgatatgagtgaagtagcaagtgctgctcggtctgatcatgctaaggacaattttaatagtttttctcatgaagacgatgaagactacgattataattatgatgactaccttgaaggaaacgattctacagtggttcaagaagaattagaaagtacccattcccagaaagacttattagcagagactaaggccagtatagagtcggatgatcaaagaattcttggaagccatagtgacctggaaccttctttgagtgcgcattctgaagcccattctgattctagtgagtcagtttcaattgaccaattttcgtacgatccaaatgaaaacctgcaaaatctgggatctagtaatgctgctcccatagaggaaaaaagcaacttaatctatgctccaattccaagaaacaccaggcgtgattctatggaattggcagatagtggtacagcatcgtcactggagctggaagtagaacaggctcccgttgttagtaatgaaaacagccccttagtatccccacagctcctagccaaaaataatgaggaagagatttttgttgaagaaccaaaaaagctcacggttattaacacggacgaagacttatcgcaaccacggaaactctccgttgttaacagcgaccaagatttcttggaaccacttgaggctggggataaccaattgcatgtcaattcatcgcaatctaacttgaatttagctggaaattatcaacattctggagctaattctaggcactcttccatatcgaggaacaagctttttgaagatagctcgtcatctgacgaaaatgagtcggatcacagcaatatcaattttgttgcaagatcacccattcgaaagatgtatgtcactaataatgctagtcctccagatttttttgtccagcggtcggaagaaacccatttggaaccagtgtctgatgatggacatcatgtcgaccgatcttctcctttgtccgcaggaaaacgagatgatcaagaaaagaatgactatgtatctgcctacgaccgaagagaggcgtcatttgtggctccgttggttcacgttaatgaaccaactgctgttggatcaaaggcattgaatagaaggccaccaccaggaatcagcacagcacgtaagacccgcggtgtatctaacccccctccgccagaaatttacgatactcatatccaaaccataactccagttgatccctctttaaaacgacaagcttcaaacgaacacataaaagaagtacatgaaggtgaaggagtaccttcggcatatgttctcgcgttgagggaaagagctggcatctctgtaagcaaagtcccagcttccgaatggaagcttccactagctattcgacctcataaatccacctttgcaaagacaaaacccaactccaaaattagtacagtcagcagaaggttcctgtcgaactctgacatcaagcatggaggcagtcttaagccccgtcttctggcatcggaaatcgatgatactgatatggtcattcttcccaaagaaccagctcacactccaggtaaccagttgaggaaacttcaaacattgcaggatccttctgaagatcagctgggagatttagttgactttggtgctgaatccacattacagagaaataccagtcttaccagcacctcaacagttcagcctggaaccgacctacatccaatgcgactattcattgctaatccagacggagaagatagttcttaagtattctgtattatataatcttacttttccgccaacctacttttttgttttcgcgcgcgcgtgtgcccgtcgtacttgacaacaaaacgacaagatcgacttaaccagctaccaaggttgactgattcactatgtcagacgttgcttatacgattcttggtgaagtaggttattttagagcatattgtatgcaacgaaggtactaacaagttctagtcgaattttcacgaacagctcacggttcaggagttcaagaccttgcttgagaaaggtagagatgaagaaaagattgacaccatgaaaaaggtccttatcaccatgctaaacggtaatttaatgccttcattgttgatgcacattatccgatttgttatgccttcaaagaacaaggaattgaaaaaattgctctatttctattgggagatttgtccaaaatacgaagagaatggtaagctcaggcaagaaatgattctcgtctgtaatgctattcaacatgatcttgctcacccaaatgagtacattagaggtaacacattgcggttcgtcactaaattaaaagaaccagaactgatagagccattgatccctcctattcgtcagtgtttggagcatagacacgcctatgtcagaaagaatgctgcgtttgcaatctattcgattttcaaagtatctgaccacttgttgccagatgccgcagaagttctagggaacttcttggctgtggagacggataccacttgtaaacgtaacgctttcgcctgtctgggtcaattaaaccgtgaaatggctcttggctatttacaggaacagcttgctgatttggtgagtcttgactcacttttgcaattggcctttattgagtttattcgcaaagattcaattgtcgctccggagttaagagagcaatatctgagtattgtatcagagttgttggattctccaagtagctcggtcggttacgaggcagcaattacattgactgtattgaccaattcgcagattgaggttgccagtgctgcttccaagttcatcgatttagcaatcaaagaagctaacaccactgtcaagacaattgcccttgaaagacttagagagctatatctaagaaatgttggcatcttagacgattacgtgttagatgtgcttagaattctcactacttctgacttgggtgtccgtaagaaggctttagatttatctctggatattacctccagtggcaatgttgatgatgtcgtgaaattcctgaagaaagaattgacgaaatctatatcctcaaatgaggacaaatcaatagagtatcgccagctgcttatcacggcaattcacaaatgtgccttgaactttaacagtgttgcagcagatgttgttgatctgttgttgggatttatcgaacaactgaattctgctgccgcatcagaggtagtttcatttgccaaagaggtggtagagaagttcccggccttgagatccaaaatcatcaatcgtttattacatgccttggagaacgttaaaagtggaaaggtttacagaggttccttgtggattttgagtgaatatgctgaagaagaaaaggatatccaggacgtatggagacatattcgtaataaaattggtgaacttccaattttaagtactgaaaagagactgcaaaacaaagaagctgttgtctccaacgaaaatgatgaaaatggatatactaatggctcaagcaaaccaattattttgcctgatggttcatacgcaacagaaaatgcatttacagccgagttggagaaacatgttgaagataaaactggggaggagaggccaacattgcgtgctttgattttagatggagacttttatcttgcagcagttctctcttcgaccttactcaagcttatcctgagttttcagaaaatttcgtccaacaccaagattctcaatgcaatgaaggctgaagcaatgttgattatggtttcgattttaagagttggtgaaacttccttttccaagaaaaagattgacgaagattcccaagagcgtattttctctatagtcagattcttggctgaaaacaaaacagacgatgacttcatccaacatgcgtttttggatgatacaaaaactgctttcagaaacttgctcattgaagctgataagaaaaaggcccagaaagataagtcaaagttgcagcaagctgcccaacaaccatacgacagtatttcattcaggcaattttccaaagaagttgacactgaagaatactcattggaggaacaacttgcggcttccactaaggatgatctgtcctccaaattaaaaaagatagtccaactaactggcttctctgattccgtatatgctgaggcatatgtgaaagttcatcaattcgatgttgttcttgatgtcctcttggtcaatcaaactactgagactttgcgtaacttaactgtggaatttgctgctttgggtgatctaaaagtcatagataaaccgggaacacaaaatgttgggcctcatgggttccttagaattcaagctactattaaagttacttctgctgacactggggtcatctttggtaacatcatttacgatggagaaaaagccaacgacagtaacatcgtgattttgaatgatatcaacgtggacatcatggactacattaagcccgctacatgctcagaggcccaattccgtaaaatgtggaacgaatttgagtgggaaaacaagattattgttaagtctaacgttgctactctcaaagagtatctggatgttttactgaaaggtaccaacatgaattgcctgactccaggtgccatcattggggaggaatgtcagtttttatcagcaaacttgtactctcattcttcattcggtgaagacgcccttgctaatctgtgcatcgagaagcaagcagatgggccaattattggacatgtacgtattagatccaagggtcaaggtcttgcattgtcgatgggtgatcgagtcgcagcaatcgctcgccaatccaatacggctaccgtatcggttgtctagaggtctaattcgtgaattactattgacaagtatatacaaagagcaaaagaattataaagataattgcgatgagcctaatggtcgttcagtaaatcttttgggattctttcagttccagtgaaaggaattcccaatccagacagaaggattctagcatccatatcaacctgactagatgtgtgaaattggacatctattccaaatgttctaggccatagatcttggttggcttcaatttcagggaaaaacttaatactctctggttccaagccaaaagaaatggttccaaatcggtcaccagatctattggaaatgcctttaaactctctgattcttggtaacaccaactctgtcaaggtggacaaaaactgggacatttctctaccttccaaagcaaccttagcacccattttcatacctggacgaagtttccacgtaggaacattagttttggcgtaaattggagttggtttcacaccagtaatctgctgtagttgtagtgtggcagggatggccagagaggagtttaatttagcttctttcacaaaacacgaaagagtgatcttggtcaaacccggaatattcttgtaggttctcggtttgatatctggagtgggaacacgttcacctcttggtactcgtggaggacgattgatatgatagggagaagtcaagtcccattgtcttcgtttatttcccggaacggttttttgaccatgtacatagtttatcaaaagaaggtcaggcttcaaagtgttctcataatattcttggactctatcttgatgtgtgtaacgaggaacaaactttggagatctgatgtcgtttggagagagcttcaactctggatatttaggagataacttggtcttgtcaattttcaccctgtggtgcactggcttaactatagagcatcccaccttgtgtgccgtaggggagctggagaaattacggattgccctgttaaacatctacctattaagttgttcgaatggacttttcgaaggtgaaaaaaatgtttggtagagtgggtaccatttgaaaacttttcgcgcctcaaagaggaaagttgatttcagtgcttatataatccaaaaactatctcaagacttccaaacagaccacatacaaaacaaggtgaagtaatgcgattcggtttgcccgctgacttctatgaggatgatgccaatgaagaggatcatcaggctttggtttcaaatgagaagatacggaaggatatttcagacttgttgggccaacttcaaattgattcggtgaagaagtttccaccaccaatatcaatcatggaggaaaccatccacttgcctgaactgaagaatcctgattacaattcggaaacagaggagtctgctgagtctgacacttctgagacacagtctttaaatgcatattttgactctatacaggattatgtggaacgatccttgaagcaaaagatcagtcagcagagagaatcagttaataatgttttacttaagcttgaagaagaaaaaaggaagaaagaggctgaaagaaaggccaaagaggaggctgaaaggctcagaaaagaagaggaacaaaggaatcagagaattttagctgaacagaaaaagaagaaagaggaagaggaaagaaagagaagagaagaagaacaaaaagcaaaagaaaaagctgaaaagctactgaaagaaaaaagggaggcagaattaaaagccaaggagagagaggaggccaaaaagggttttggaataacaaatttctcggatgttgagaaacaatttgtgtcatacaagaaacaaatcgaacaaataaagaaagagattgtagaggagctgaagaaaccggagaattcagaactaaagaagcaagtaaatcaattgaagcgtaagattaacccaaaatttggacagttgaataacagtacctctcaattacagaaaattacacaggaagtactccagttagtaggagaagcactaaacttgggccaattgggattaaaatggatcctaaattttatggcaaaagctattgtctcccaggcagaaactgaagtgacagtatctccgcgggcggctactcctttagcaaacttggccgtctcactaatgactgaaattccggacttcaagacctatcttatggctagattcgtaaagaaatgtccgttaataatcggatacacatgcaaaattgatacagaagacggaagagtacgtatgggatggaagagaaattctgatggtaaatgggaagacgaaaccagatacaatgaaagactgggtggaatcgctatggtgtattttgtgataacccaattgcgcgtggaaccagacctagttcccatatctgaaagttggaagtttcttgctagaatgcttaatactcctttggagttactgagcaatgtgcactttctggtcaccagtaactggtgggatgcctgtgcaattgaatttgtgaatacctacggagagcaggctaagaagttgatgaatcttgtatgggatgactggacagcctccgtttcagacaagaagtttagtggcgccgctagactacgtttactcggtgaggactacgtgaatggcagtatagaaggacttgctgagatgaataattgaatagatagagatacgataacagaatgattatgtaatacatctcgaggtcgcagtttccaatccataaatatccaagcgtcggctatcgtaaccttgaaatttgatcccccctcacagacattcttcccgttgattcaacccaattgcaaaatgactcgaccggtgataccgataccaaagacaccaagccccccctttcccttgcttgttaaaagagctccaatcattgcaggatttggtcgaggttcctctgctattggatgtcccacagctaatatacctattgaggcgctctcagaggcggataaactagacacaggcgtatattttggatggtgtaagatacatcccgtggatacacagaaggatgtccaccaaagacaagatgggacacaagttgaatttaaatacggagacggcctacgaaaggaggttgatataaatactgttctcccaatggtaatgtctttgggttggaatccattcttcaaaaacaaagaaaaggcggcagaaatccatgttattcacaagtttcctgaaactttttatggggctgagttgacctttaatatactgggatacattcgccctgagctagattacacgtcggtagagagtttgatcaaggacattggcatcgacattgaggttgcaaaagacagcctagcaactgaaggatatcagagttacaaagaacaggtccataatgttaaataagaataattaaatcctttaatagagttgtatagtgtctttcaatggttttacataaggtttaattttctgtcgtcagctttggcaccaaacatttttcggagggtgttgatggctacagtcagcatttttccaaaccagtagaaattgagcaggtcaaggacaagattggagcccaggataacaccaacattaaaccagttaagccttggatcacctctggctccatagaaatcattggccagtctaaacacttgataccatccccaacatattctgatcaaaaaaaagaggagaattaggatgatgttgttgataagtttgacagtgtcacttatccatgttgggaacttgattgcaagccacctaatattcaaaaatggggttgatacttcgaaaagaagaaagataggggcgtagtacataatgacaggagccggcgataatccaaccaaaaagacaagagcagaaacgacaccatgcagaaaaaattctactccaaaatactttatatacagcaaacaggtaagagcatcccagatgaaatatccaacggcaactgataccaccatttgtccgtaaggagtggatgcgaaaacatggtcttgctgtaagtgggggtttttaaacaggggaatgcaaaggatcaatatcaacaaactttggacaaatgatactatgtggatggaaaagtcaattcgtgtcttcggtttcaaagaattataaaacttggggtaagcaaacttcacgaacagtctgcttatagtaaatagagattgatatacaagaaaagaagccactatctcgtgaatatgctgtgaaacgacaccttttggggcgtatggctggatgtactcctggaccagggggactcttagattcttcaatggatcatcatactgataaattgatctataatagttgaaataatagtaaagctgatcagttatgagcatttttttggccttttctttgggcagaaggagtgctagtagcctgtaatctagtgactatgctcagaatatggttcaaaaacgagatatttaagattagaagcaagaagcacccagcctcaaattaaaaacaggggagcagcgcgccggagatttggttggggttgggtttggccaccttgcgggggtgcctttctcgcctggttcaacaacaatagtgaacaataatcaatgcgttgccaaggtctgggataccgtggtgaataaggccaagagctggttattccgggcaattcttgtagactacgaggatacttcttcaatcaatcagcttcgtccccaacggaatacctaggcagagattggatgccctagaaatcacagaaaacgtcgctgtggatcaaggcgtacagtgcgaggtaatggatgatgatgttctttgcttctagcgatccctcttcaattgctcaacacttcgtctagctcttctcaattaatgatacgaacgttcaagcctacgccgatcttctttccatcgatagcagttatctgacgccatattttcgctaccagtcacagcccctctatcaaccttgcttataggcttcattctttccatggcactcctaatcaggtatttaacaacatttgttttgttatttaaatgtgtgtatggtgttcgcaatggtactacttgccacatcccacacaacgtggacaaatgtgcctatgttcaatctcattgtgacaacagcatctttgacatctccagattttatttctgtaccgttgtagagcaaccacatgcgactgtgttattcaactttggattactctcccttttgggacttctgttccttggtttaggtgtcattacgtccgaatacttgtctccaaatttacaagaaatttcggctatgctgaagttggatcaacgaatagcaggcttgacccttttatccgtgggtaacggaactccagatcttttctctacgtacactgctatgaacacaggatctatcacattagcaattggcgatctattgggttctgcgaccctggtttgcacggttgttataggacttatgggaatattttcatccttttcggttcatcgatccgctttcctgatggattttgtcctctttttcgtgttgttaacgctctcaatatggttcattcatgatggaaagttgactgctggagaatgcattcttatgattggtctttatgtgtcttatatcatatacgtgcttttgcaaagacctgagtcggaatatcttcaagtcctagatgccgaatcacagcgagcgttgaccccaatttgctcaagcacagatccttctacaagaaaactttgggatcatttgaataagcttataactcaaggtcaacagatgagactgtcagtttatgatgctctgcgcttcttgtctattgaagttgataccaattatggaagtaatgttccaagacccgcctcaggttcgttaccaatatccgctcctgagacacctcagtttcagcgctcatattcttcgacctcacatttcaaagcacctgcagttgaatctgatgaagagctagcagatgacgaggttcccagcgttgatatagtagctcctcaaccagtttgccaagttccccagattcatctggagtcgatagaatctgatgtttcccatcttgaagatcaaaacgaaaaaatgaatgcttttattgccatatgtactcatatcatcaaaaagaatggagagtttgactttaaaaaaagaaaatggacttctttactacggctattcagtttcccaatcattctaatattctcacttaccattcctataccagatgcagacaataaccttttcatcatcaatttggcgttgaccccactactattgctgagaagactaacttatgatgtgatgatcctagcattatttttacccgttctttttgtgactgctcatgagtttctttccaaaacttccataaagagaatcatctctatcattggattcatcaattccctggtgtttataacgatactgacctcatctgtagtcacgatcctaaagaattttggcattattcatcatatcaatgaaactgttctaggtctgacattgatggcattagggaattcaattggcgatatcatcagcaatgtcacactagccaaaataggccttcctcatacaggtttgagcgcatgttttggctcgcccctactgtacatcctgttaggaataggaagtaatggcttgtttctcatggccaaaaatgggaaaagcagcattgagttcgaagtggataagagtttggattttagcacaataggactaatggctgtgctcttgctctacatcatcattatgatcacacatgatgagctacgtattaataaaagtcttggggtagtttgtgtgttatggtgggtatttataacaggtgtaaatgtattatataagtaatttgaacactatcattataggtaaaacttcttcttgtctctatccatagatggcttatgctcccaatctatttcttctctaattcccttctgcacccgcctcagtttcatagtgaattgggggcccaattcctgtaatcctacccttttttcattcttgaacttatatctgtgtcttctgaagaagataaaatctctttggttgtgtaaggtgaccacctgtcgaccttgaaattggggtctatggggaaacaatgattggaataaacgtccaaccgtctgacccaggcgggtgctgaaattgtttaaaattagttctggaatatgagaagttgggttaccatggccggcaatctttttagattcgataatgttggtgacagagaaataaaacgtgggcccagttggtaaatggatgaatgtaataccagtaactttattcttatcctcattaacaacaattaaatccgaaaactgtctgttggaacaatagcttgccatatctttcattgtatacttctccttcctctccacaaacacgcttccgggaagaaaatcttgaagcatcttggcaaatatcaatccatttttctttggattttcactggtggtgactaaaacttttgggtctttatcagtgttttcaaaatactcactaaattcatcagttccttccaactctgcattgacggtttcgtcaaagaccctcatcgattcaattgtgtttggaacattttctgccaatctcttagctttcagttctggattttcacgttcttctttggttctctctgctctctcttcgtggcgtctcttgttcctttcatctttgtatttggcaaacagctcctttcttctgagtctgtttctgacccttatcggtttatccggagccatagctaacaataggagttttcaacttagagtgaaagagattaattttttttttttccttcttttatctttctggaaattcgagaaaacaaaagagagggaaaggggaagggaaatgaagtatttcaagacttggtatttacagtaaacatatctaattatcacctatgatttgacatcttcaggaacttccaatccaacgcgacgagctgtctttctaaccttgttttcttgtgtcattgaaatgccaggattgtatcgttccagaagaatacaatactccctatggttggctacaaaagtggccaaattctccacgtgaagctcatctttggggtctaaactgtgctctttttgtaaaatgtggtcaataaaagaaatatcggcgatcggattcaggtgttgttggtcttcgacttgaggttcagactttccctccctagaagcttggatcttcctataagctgccattgcctcatttcttttctggagcaccttctgctggtctttaagcgtgtgtttggatgtttcttgcaactctttcaaaagagtggacgctaatcctttgacccttgacatggcgaatacagctggaaacggagatgaactgaagtgaatgtctagttgatctaagaaatatacctattcgcgaacttgactttaagtcctgtaatatttcactttagtctccagctgaagccaaacaaactgtattttcacactcgtttaaatgtcttgggaggagttgtcagctgttgttgctgagaatcctaacgatttcaagagctgggagaaacttatctcttccgccgaacaaattaacggcggcattgtaaaggcttctagtgatgaagacaaagagctattgaggatcctctaccagaactttcttgtacagttccccctctgtgagcaatactggataaactacgcattgtgggagttcaagcttggtgaaactgaaaaggcaaaagatatttttcgaaaatcactaaccactttgcccaggtccctcttgatctgggtggcatatgccaagttcatgattgatgttgagaccaatcgagataagctgcataaccaggtacttgaaaagggaagaagaatgataggcttacatttttactcgcatctctattacgacgtgtatctggattacttgaaaagtgaagactacaagagatacgtcttcctgctgagaagaatactagaaatccctttatatcactacagcaaatacttcaaactgtggttcaaactaatagaaaatagtgacatggaaggcattaccttaataattaatgaagatgacctcaaaagttggggtcatatgggattacaggatctgaaagtcaaacttagaaagacttatatcgacctgtatattacaacacagtaccacactttcaagctttggaaccttgagaaaaaactaacacattcaaattacttctcagccagccctctgcaagaaattacaagaaatgactgggtttcgtatgttcttttcgcctacacccagagcatggcaaacccacatacaaagaaccaacatttgccttatgtcaacgatcaattctttctgacagtaattgagagatgcttaatagttactggtacttatcaagatttctggcttatttatgccgcttattatctacgcaaaaacatggttcaacaggcgaaagagcagctactacgaggaatatacttgaacccgatattaaacgttgatttaagaatacagttggtcgacttgtatctaataaccaaagaagtccaaaaagcccattcagtgattgtagagttgtattcgtttctaccgaatagttatgaagtgtttttgaaatacttaactgttgaaagacttgcacagaaagattttgacctgctgaaggagttccaagacaaattggaagctatgcagtcgacagaatacgaagcccagtttgattatctttttgcggatattctcagatatgatatcccagttgagaagctgccggaccttttcgaaaagtacgacactaagtcatcgctgatatattggaaaagctacctctcattaaacatactctatctaaaatcattgaaaaagtttgaagcaattaagacattagccttggaaagggtgaatcccaaactcaaggacgacctagaggaacacataagaggaatattttactgaatgataattaccaaacgtcttcctgatatctgttggaagttttgaactctctaatactttctgtagcatcttcctctgacaatcctttctctttaatgaggatttcaacaatcgccttatttacatccttagccattttaccagcatctccacatacgtagataaaagcaccttggtccatcagttcgataaattcccttgagttttccaataacctatgctgaacataaactttgtgtgaattttctctgctgaacgcagtgtacatcttgaacttatctcctaacttcttcgaatatgttggccattcgtcacggtaaaggaaatcctgctcagaatttctacagccataatagaggatagattgaccaatattaggagttccattgtcaacttgctggcatctttctctgataaagcctctgaatggagctaccccagtaccaggtccaatcatgatcactggcagggccgggttgcttggaagtttgaaagtggaccttctgatatgaactggaagtttatatggagaaaacaaatttcttgggccgttcaaatcataggagacaggcgccttaacagtagatttgtcctgattcagctgaatgttccatagcaaattagtggtgactcctgtcactatatggtcacttccagtaggcgtgaaggcctcaatcattgcggtgatatgaatagtttgcttttcacttaatgaagatgatgagatagaatagtaacgatgctgcagattaggcatggtctcgatcaggaagttgaatggaacattccatggagtttcttttgagactttgaacaagaggtcagcaaggttatagtattttgctgtgacttcgttgtggaacacatctttgctctccgataatcggattacctcctgtttagtagactgatcgggagcataaggaatgaattgcttcaatgtctgtctagagattggtccagaaatttccaggtgatgacgaacaactgcttcgtatgtggttggaaacggaaagtgaactgtgacagtagggtccaggaactcaatatcaaacacagaagatcttttgtctgtgaggttgaacactttcaaaaagctctcgacatgctcattagcattacttggccacacggccaaatgatcgccagtggaataacgcaagttggtgttgctgagatcaaattctagatggatacagtttctctccgaagtttcagaacagagttctctggagctggagatgggcgcaatgtaaggatgagtgtggtcgaagggaccgtattgcagcagattctcatcttcacgaagaacataagccttattaggttcaccaacagagacattaggagaagatgttgtaagcgctgtgttctcctttacttttagacctggctggtagacaacttcatgttcctccaaatgcaaatccttcttgattgtatcaaacagggaatctttccatgctaggaagtcctcgtccatagttgcctgaccatcatcgccctcgccaaaggttccaaccaattgagcaccaagttctgagaaacgcttgttagtggtcttacccatttgattatagaactcgtaagtagagttacccaacccaaacacagtatacttcagattagacagatcctcggcgtcgttcttaagaaactcgataaactctacggcgttgtcagtaggctcgccttcgccgtacgtagccatgaagaaagtgatgaaagtgaacccttcgacctgctctgggatatcgttcagattgtcaaaatcaaactctgacaagtctccacagagggtgggaatgctgaacttggattgcagttcacgagcgtacttatgagcataatcctcagatgtacctgtttgtgatccgtaaaggacgagtgccttcttgttggtagagttcaaaatctcaaccaggtctctggtctgaaatcctccagctactccgtggacggagttatcatcctctttgccccaaagagatcctttgctaaagtaagctatcaaagccaaggcaatagcaatcaaaacagaaaggtccaaggtatccataatgacactttatattcaactatcgtaaatggaaaaaaaaaaatggacaactatcccctgggaggcttcaatgggagacagacgtacagatataagatgtgaaataaaaaacgtgatttttcttcccacgcgataaatacgagcgatatacgagagatgtcggatgacatgtagagatagaagtgaatttgtatattaactagtaatctaatgaagtagcgggaaagtgtaaacaggtggttagagaggatctacagccttgttcctcttcttgaccatactgttttgataagtacccagtacaaagtacaccacgttgaaaaacactacccaatgatttggcgaaagataagtctgggcgatagccagagctatactgctggtagcccaagaagctttcaaaactctaaacagcgacgtcttcaaggctactttcactatagtgaacagtctgtcaagttcttccttgattccgttgagtccaccagcataatattgctgcacaaagctctgaaaagatattcctggttttgcacccaggatggaaatatagctgaccatgcatgtacacagtatcggggttattgtactcagggagagtaatatctggagcacccttttcgtgggagtaaggggctgtttaaatagtttgttaaggtacatgtacccataatgtgaaatgggagcactcacggtgaacccgaaaaaagccatcagaggcacccgtttgttgaaagggtgttttatcttcagtggttcccctgattcgtccttgaggccatcaatttgcatttcctggtagtcgtttgctattgctgttacgatcgactcattcagtccagctaggactcccgcggtaacactctttgtgagcagcgggtatttgttcagatatcgcaaatatagctggttgaatgaaaccttattacttgacatgtttgtttgataggaacgaaggagagcaatgaaagcagattcagatagaaaaaaaaacctaaacacgagacttctccttgaggcgcggattcctgatatcttatcagacagattgttcagatcgggtgtgcagcatatgcgaacctcgcccaactccgtcaagataaataaatcttctttttttcttgtttctacacgtgcacggtcacgagaccatcccatcacggttgcgtgtcttcaccgataattggttttttttcttcctttcctcttcgtaagaaaaaattttaatttgaaaagttccctttattaaagaataacctgagcatagccttattctgaaagttatattctcacagacattacagtatagaaaaaatggcatttactccaggtagcagaggcggtgcccgtggtggccgtggaggcgctcgtggcggcttcggtggatctcgtggtggtgctcgtggtggtgctcgtggtggattcggaggtggaagtcgtggtggagcccgtggtggatttggaggtggacgtggtgctcctcgtggtggtgctcgtggtggtgctcctcgtggtggacgtggtggtgctcgtggcggtgcccgtggtggtgccaaagttgtcatcgaacctcacagacatgcaggtgttttcattgccagaggtaaggaagaccttttggtcaccaaaaacattgctccaggtgattccgtttatggagaaaagagaatttctgttgaagagccatcgaaggaagaaggagttcctccaaccaaaattgaatacagagtatggaatcctttcagatcaaagttagctgccggtgttatgggtggtttggacgaattgtttattgcgccaggaaagaaagttttgtatttgggtgctgcttccggtacctcggtttcccacgttgctgatgtcgttggaccagaaggtgttgtatacgccgttgagttttctcacagacctggtcgtgaattgattggtatggccaagaagagacctaatgttatccctattatcgaagatgctcgtcatccacaaaagtaccgtatgttggtgggaatggttgacgttgttttcgcagatgtcgcccaacctgatcaagccagaatcattgctttgaactcacatttattcctgaaagaccaaggtggtgtggtaatctccatcaaggctaactgtattgactccactgttgatgccgagacggtgtttgctcgtgaagtccagaaacttcgtgaagaacgtatcaaacctttggaacaactgactttagagccttacgaaagagaccattgtattgtggttggtagatatatgagaagcggtttgtaagtagtcgagggagagtctgtaccattaatttgttagtcataaacttgttaaaagttcgtttcggccctgtgccacccaaactagatgtaggtagcgttaatatagggattagtagagcattttactgtcttaccagatgacatttctgttcgcgattcatttatctagggaaccccatctctcgcttatccttcctgagaaggtacacaacaggcaaaaaggaaacgaaggcggattaatgtccagggtagaagaaaatagtatcatctcacttgcttcagatgaaggggagtttgataatgacgacgttgaaattataagtgcctgtactaataggggaccaaccaacactgacactagaacggctccagggcagcaggaagtcatcgatgttgatgctctggtagaggacacagaggtggtccatgatgatgacgatgatggcgatgatgatgacatacagtttctgagtgaatcaagagctgcaactcccgttgaaagggcggacgttatagttactccaaacggcgacttccccatcccaccaagaagagttacattgattcaaagagcgccatttcaaaatgcacgatacccgcaaacgtcccgtattttgaacccgtctgaactagtttttcggactcaggaagctcgcagaaggaggcaacgaaccattcaagctcgcaggagaaaccttcaaaatttgtttgctaatcatggcagttccaatcgtattttcttccacaggataggcagccataatcaaggagcttttgaagatgatcctgatgatcctgattatgagtatggtcaggaaatgttgcctggcccttttggagcagtatttgtcaactctcatattctaggtcgaagaaacgactatgttgacgagaacaatatggcaagagtaatgcgtatgattgccgaaagtgaagaaaacatggaagatcagagggttgactcaagacataggttggctcggactgtcagaaaaaagaaggaatccgcttctaaaattcgtacgaaaactgaagaagcatcttttttcacaaacaagatagataattcagatgacctccgatgtcttctatgcggaatgcaacttggctctgggtttcccgctgacttcaaagtggatcatgaacagaactctgcatctggtattctgaaatataaggttcctgcgccatggcaatgttgtaaccaggtgaccgatgtggataaagagctctcaaagaaagtgttttttgccaaatgtggtcacgtctattgtggccgatgtgtcaataatattatgcgttctgacttacgaaagcggaaccgaaagagtcagagtattttgcaggcattgaactaccaattgctttcgaccatcaagtcaccagatgaacttaaggaaaagatagttgaagaatttaattccaaaacaacgaaacaaaagaaaccgtcaaaaataaccaaagaggaactaaacatatcatacgaagatatttgctctccttcagtctgcagtggttggaattgctcgcaacgcttgagaaatgggaaaaaggccttcagagagatatactattaaattattcatacttaaaactgggtttgcagcttcctggtattagtgctccagtgttggtattgattttgtcttcttcgtcctcatcaaaaacagaaggatatttgacttcatcgcaactatcgcaggtcgataagaaatggtgaatgttgactggagtttggccaatattgagcacttccttaatcttatgcacctttgaccccggggtagtttcaaaactttcttgagtacctcgtacagggttacgattctgaaagatgatacgaatattttcgtataaatagaatttttttcctctaatgttggcaaacttgagctgtattgtggatgacaacattttggactcgtcctctccgccttttcttttaatttctatggtctggcgcagcaaggttttgtggtttttaggtagagttgatatgtcgtactcaaacacattaacaaaggagatattctggtcctggtcaaatatcaggagttgtaaatttcccttaggtggaaccatataacctggaaattccctctttgttgaagcatgggtaccggtttcggaagtagagttttcttgatcgatatagtactgctctaaatcgatattacccacgtatggagtccccctggtgtgaggcccactgttgccattcaaaaattcatgatcattccacttgtagtaaacggcttcaaatgggatcttgatgtgtttataaaaacgctgtttgttattgtggctgcttgtgacacttattttagcaacaaaggctatgggatttgaggggatccctgaagtccgaccattcaaaagggactcttgaaatgagccagtcatcgcaagagagcttcttcttctaaaatttatgtcattattggtattgtgtgacaatgagtctagtttgcgctggcacttgtagcatagtcttttctgtgtggatgaaacaacgggattgttcaatcccggttcagcaattgtctgagacaacgacgatcggcgtctcggttggaacatgagaaagctctgtggaacaggcatttgggcaatgacgctgaaagatgagtatgaggcaggatttcagtcaatcagctatgatttttcgattgtaggctgtattgagttaagaagaacgtatgataaggggcagatgatatcatattatagcgcgaaatgactaacatcataatcgaccccagaatcactcaagtgatcatttatggttatgtaattatgaaattgtaatgggaaattgtcaggcaaaagtatatagcccaccgaataggtacgtacactgcatacatgggtcaaagttatcttgggccgaacaactctctgaaaagtttaatcttcaagatgaaagtcagattgctcgattagaattgggcagacattgaaatagcctatcactctaatgaaactggctaattttgccaaacgaaaactcaccataaacactgccgactgacgatcaagttcagtagcacagataatgctcccaactaacattctagaaatacaatctcattaatcagactcatgtttcttaaatgataataatctatttatatagtattgttcttccgataccagtccttagagcgcgcgcccctctttaatcagctgcctctcctcctgctgaatctgaaacgttatctctctttcccaccagatcattcgaccatagcaagcctgttattacatggtcaacattagagtatgtttcgttctatcgaccccttcatcattcctttcattcaattgtctaactttagatttctctgctaagtgcagcggttattgtaacaggttgtctgaactctgtgttcaccaaatatcaagataatcaatgtgttagaaactgtcaggacccagatttctcgaagcacgtctactttgaacagccggctttgcaaactctgcagatgtttgtcggagaatctggttgctgggtagtggtcttcttatcttggctttcaacagttgtcaaatactattctaaggggagaaaaaaaccactttacgctccactgtcagaaggcgactcagatcagacaaagctacctgagctgactggtcttagaagcttgattttggcaattcctgctgtttgtgacgtgtgtggaacgacaatgctgaatgtaggcttactctacacccctgtgagcatttaccagatggctagagggtcattgattttatttgtcgccctattctctgtgttttttttaaaccgaagaatatccagacttgaatggttgtccctttttgtggtcacgtttggtgtattcttagtgggtctcagtggagcacttggaaataaagttcacatatcaggggacaaaaacacttcatttgcagtcatttttggtatcactttgatcctcattgctgagatttttgcagcatcgcagtttgtgtctgaagagtacatcatctcaagatcttctgtcgatccgttgagattagttggcttcgaaggtatttttggaggttctattacgttcctggtcatggtcatagcatacagtgttgttggaagatccaatcctggtggaccatttgatatcgtcacttctttcaaggatgttacggctaactcacaagttatctggtcaagcgtggcaatcatgatatccattggaagtttcaatttttttggcatttctgttaccgacgagttaagtgctacagccagaagtactatcgacacgtgcagaacattactcgtatggctagtctccctttatctaggttgggaaagcttcaaatggttacaattagttggattttcgcttttagtgttaggaacactaacctttaatggtgttctgaaggctgagaactggtactttattcctgaatggttcaaaaaggatgctcctctacctggagaaagggtaattgacgttgtggacgaacaaatcgaaagattctagtatagaattagtcattataagaagatcattgaattcatccttgtagcgagtttcccgtccagaactcctccgcccatctcttccctcccatcaagcattcgcgccgatggacagcgtaactcaacatcactcgaagactcaaagttcaaccagagacacaacaatggacgaacataggctcttcaagttcccagtatttagacttcccaaatccgctacagttagagcaatggggatgtacctttccggggctctctatgcgattggtttttgggttcttttagacgctgccctttactccaaacgggtcaacgcctcattagtccatgtcactttcgttgattgggttccagcaatatgttcatctctaggtatgctgattattaactcgattgaaaagtctgcattattgaacaatgatgcatcattcatgcaaccatcatctacaacaacctggcaggcccgggtggtgctgtttatcgggttctcactacttgccacaggaattgccggttcatttattgtacttatactcaagtttttgatcaaaggttataatacatttcccaccttgggtatgggggtcgccaatgtggtatctaatgctagcatcatgttaagttgtatagtgttatgggtggtacagaactttgaggatgacgactacaattactcattggccctgtgaatttagtttgtattaggtagaatggaaggcaaaaattgtgcactaatagacttctcatagtccgtaaagttaaatagagtgtcgctgatttcaagtgcctgtgatgcattggtgggatacactgtgaaaccaggagcgcgcagttgatcgaagaagcggtgggccattatttgtgagcctgaaaacctggaggcaggctcgtaaaccaaaatatgcatcagtaggtctatcgcatcttgtggtgaattattgaacaccttgttgaaacgggtcgaaactttaggactgaacagtttggcggagtacgtagggccggagtagttggggttcgattcatgtaaaaattgctttgatggaggacctagtagatgtgctataacacgcaattgatgtaaggagtcctttccgatgaacaaaatgttgcccaaaagcatctcagacatcacacagccaaacccccatatgtcgatctttggggtataatattgacagccaacaatcagctccggagcacgatagtatctcgagctgatataagcaacgctgggctgattaggctccagtttctttgcagaaccaaaatcacatattttcagctccatcgtggatggatcgatgaggatattagatggttttatatcacgatggcatatatcaaagctgtggagatagttcattccacgagccagctggaatgagtaaactttcacatgactcaatggtagagtcaacttatttttgtaatacagtcgaatctcggcctgtaatgtactgggtagacattccataaccaaatgttggtataacttgttattgtccaacttgtttgggtagttgtaaaagtatttcaatgctacgatattgggatgcgaggtccctctaagaatttccaactctctactcttgaattcactttcaaatgggaccatcttgattccaaaaggtccaagtactgtaggcgtgctgtcagatgtgacgggttccattgtagcttccacgacgcggccaaatgcacccttaccaagttcctgagtttccttaaccatcattggtaccggattatctgactccttgctgtacactttattggccagatattgagcttgtgcatccgacatattacttacgttgtacttgtttgtggcgacaggatgtatctgtatgttagatgaaggtgggtgacctgtggtctaaaaaaagcaatcgcgaagggaagacatcagtccttcgcgatctttactgtcaaaagacttggctctctcactttggtaaaatttcacggtaacttgagagattcgaaaacgactttaggatcataacatgtggggatctatacgtttaagggtcccactggtattcaaccaaggaagactattttcttcgtcgttgccctcccgaaatgccccaaagacttttggttccatccgtaaagagtttgcaaaccaaacgccttcaatgagctcaacgtccaagcaagttgaagaattgaaacaacagagacgagtgcccaacgaacaggtggtcaaatacgtcctacactgttcgtttaccaagaataacacacatttgaccctcacagaagttgtagaagacaagaattttctcaagaacaacgaacaactatcatcaaacgagcaggcattatattacttgcaactcccacaacgagtcaaggtgtcactttccacaggatgtgtcggattccgtaaagctcagcgaggtgaatacgaagctggataccaaactgcggcaaagatgtttgaaacaatagagactcgtggttacttaaggaataaaccattggaggtagttttcaaagactttggtaagggtcgccagggatttgttagtgcattgaccggcaaagagggcaccaacatccgtggtaagatctcaagactcacagacaagacgaacctgaaattcggtggtgttagaatgccacgtcctcgtcgtttgtagatgtactccctctcattctatgctagcatccatccactttaactcaactgtacataggttaatattaggtaagcgagcagtgcgcgctttctcagaatctaactccccaggtagtgattccccgtttaggtgtttagcagtcacaaacactatgcgcgaatgatgttgttttttctttccctcgtaggtttccccagtcagggtaaacaactaatatgctagtcatgtgaccatagacgagccttggtgcaagtttttttcatttccaaactgatactcttccaacacagaacaaaaatggccactgaatgtaagtaactgtttgaagatttgggaacctatgtcagatccgtgggtgacggtgtgaacaactgaatgattgaagcaatagaaaaagtgtagacgtgattcgttgtactgtctcatgttccccgaagtttcctcaattccaacttttttcttttctttacagagataactaacatgtgtagccactaaagctgacgccacaaagaaagctgccttgaagggtacttacggtaagaaagttgtcaaggtcagaacttctgctaagtttgctgagcaagagtctttgcgtctgccaaagaaccctcaatacgccagaactttaccaaagtacgccaagatcgactcatacagcgttattgtctctcctgtcaatactgagactgccatgaagaaggttgaagacgccaacaccctggttttcaacgttgccctaaaggctaacaaagttcaaatcaaggatgctgtcaaagagttgtacgaagtcgaagtttccaaggttaacactttgatcagacctaacggtactaagaaagcatttgtcaaattgactgccgactacgacgctctggacattgctaacaagattggttacatttaatctatgaatacatgtattgtagtagttagttggaaagaagtgagtataatagctttattgtagggttatgctggattagtgcctaaggccccacatatctaggtgagtgacgaatctgacggccaaacactaccaacccttgtagtcgtccttggcaagctctatagaacatcgtactatgttctaaaatgctttcttgctgtgcataaccatgtaatagccccccgaacatactgtacaaattgaattttattccgcaattatactcattaaataaaatatctctacctcgagaccagcccagagtgcacaatttttagttgccagcaatgaaggcagttcccttagcaatgttcttggataactgtccagtggcaatcttcaacagctcagtctctttagcatccactttttcaaggatatcccatttgatctcctcaataccgtttgaagaaagaacaacaggaagagcgaagaagtcaacatccgaagaatcagaatccttcagcttctcgttgatgtatttgaaagcctcagcagctcccttgatcttggaatccttcaaataaacgaaggtagactcaatgatatttggagtgtcattaatagcagccaacaatgcgtgacccaacttgtagccagcataagccatggaaagagtggcagatccagccccgtttttggctttaacaacttcgtcaccaccaaattgaacacggtggactaatgcagctttctgctcatctgacaattctttgtaaacttctggagcagattgtgaaaaaacaggaacaatagtctctcctgagtgacctccgagaacacgggtgtcgaaagcagatgcctccttgtcctttgaaagctcggcgacaaaggtgttggcacgaacacaatctaacgtagtgactccgaataatttttgtgggttgaaaacattgttcttcttaagaatctctgcgacaataggaaccgtggagttgacagggttagaaatgacaagaacgaaagccgatggggcaaactgagcgattccattagccaagtctctgatgataccagcgttaatggcaaacaaatcgtctctggtcataccaggctttcttggaacaccagctgggatgatgaccaagtcagaacccgtcaaggccttctccagtccgtcgttctcgggcaagtaagactcaagtttagtgtctgtgtcaatgtgggatagatccttaccgactcctggaacatttacgacatcgtaaagtgccaaagtggtaacatatgggttcaatttgaacatcagagataatggctgcccaatacctccggctgctccgcaaactgtgactttaaccattttgttattgttcgttggttgtaactctaaagtctatagataaaaagttagaaagtggaagtttcttctttgtttgcttgtaggaaatgagaagcctttatatactcagaagttccgagggtttttaaagactaaaaaactgttttggtcactggcatgtgtggtcatcataatttgcaccctgtgttcgcgcagtattatctatgggaggggatgcaatattacatgcgcaaacgcctagagctcggagcccgacctttcaattagactgagggtgcgaatttttgtccggccacacaaaaactgacgggttgccggagaagaaacccggagctatttggtttgggaaagtcttgctttctccggtagctacgttggttgggccgtgtactcccttcgacctttgatccgttcaaacattcaactggtgggtagtatattcttcctttacagtaataacccatcgtcgtgaaaacgtagtctacaaggtttctgggggttgtccctcctaggaaccgccgccccctatcacaatgaaaatgttgtatgtatttgtcgcctatttctgctatttctgcggggaaaccgtatacttctagtttgacttgactatctcgttacatggccttaggccataacttgcgcgttcccaaggtttgagcttcctgaaaaatacatcaggggacgtaacggcgcctatcgcacggatgccttggacatctaagtaggttaatcccaaaataaaagaggcattgacccagccaaacccttcagtggctactcctttaaaatcggcaccttgattcccgtattcagcatcaaccttgtgggggctagtaccagtggttacgtcatatttttcaactacgataccgttataatccacaaatgccttggtcattaggtatagccaacggtaacaaaggcgtttggtatgaccacggaagccgtacttgtcaagtcctacccaagctaggatttgctgtggcgcccatccataagggtagtcccattgtctactgggcctttctaatcccacacgtcctcgggatgccagagtaccagcgacaagaccaccaaattcctcaaatttagatagagacttatccaccattaactgagcttgttcttgagaactgcatccggcccacattggccaaaaagtggttacactctcataacgatgttgctttttcaacttgagattataatcaaaataaataccctcttcttcgttccaaaggtacttgtccatcctttcctttcgaagttcagcacgcttggtccattcagcgctgtgctcgacgctgttttcagtgaccagttcgtcattgaaatgctctttgataatcttggcaatgtctacctcgtacttataaagtagtgcgttcaagtccacagttgccagactggcacaaattccttccaatctataagaagtatcgtgtccactttctctcactgcacggtcatgaaggaagtattcatcgagttcaggctcgactatggtatgattgttgtatagctcatagaactcttctatagagactccatgcttcttagcatatggagtcaaaagtgtagtaaagtgtgttgattcggtttcaggaggaatacctactccctgtgggtggtaacatgacaatcctgtagtcttgtctaatctaggctcgcaacaccatacggtcttatattcgcatatggccgcgcaaaatgtacgtctaagaaagtactcggcatcttgtaaagatttttcagtatcttcttcattctgatgggcatgctcaaccatggcctcgtaaaccatgattccaaaatcagttaaaaatgggggctgtgagcggcccaagtagtaggacctgttagcattgaggatcattccataatgacggatttcatagatgaaattctccaccattcctcgagcaagatccgacattccgtccttgagtaaacctaatgccatcatgtaagaatcccagccatataattcgttgaatctgcctccaggaaccacatatggatatccttctagggtaattccaccctggccatcaggcaccttatgggttgcgagagcaagaagtcccggagtaccgttaatagatttgacatactccggatcaatcacttcattcaaatacctaacatctagccgggcccctccgacggcctcattttttcgtgcaatttctagatagaactcatattgctccgggtcatcatgtggaacgtagatacgagggatccggccatcgggggtgtcaattttggtgtcttgagcgatctcggccacattgccacttccaacttgacgggtcaagtttttccagaaagaatgagaaatcaaccttcgaagtctcttgactgggttctcattcaatctagcttcatctagcaccatctgatttcggccgaaacgtttcgcgatagttagttcctgcaataagtttgatagcatatatgttcctcgaatatcagtttgtcggtatccgtttgaattggcagttccaactctcaaaaccttcggtccagtgtcctcgatagtgatctgacaattggaatcgctatcttcattcttcaagagatctcgtaatgtctcatcaatatcgctaatgaaaaaccttctgttaaccagagtatcattagatcctcttctttgaaggtgaaccttgctgaaggcgtcatcttcgtgcaccattggccgattaaatctgttctcgacagctgaaagtgttcttgtacgaccaatctttgacctagtacttgcgcgtgcaatatcagtggcgggtccatagtattgagagggctcagagaatggatcaatgaaccccgagttggatccagtagagaaagttctggtatgatgaggttgttgcaagccgtctgggacgtcgacggctacgctgtgtgggcgttcaattgcgttgccgtcctgcattgatgaatgttgtatgcggtatgttataaggctgtaaaatggaaatagataagaggcaaaagcaagtttcttaatttttgaagtcaggtcaggcagttcgcgtatgtgggggggcaggagaagccaccaagcaaaatagcaaagttccttcccccagaagctccttcgcgaagggatcaaaatgtcaaagagaaccaaaacgaacaaatttttcttgaaaacacgcataacagagtcaatgtctgaacaaaagcaagaaaacaagccagctgaagagtccaagccagccgaaactcagacttcttccactttgaattccttttctggaactcggactcctcctacttccaatgtcttctctatgttcggtggaaagaagaaggaaactgaaacttctaaggaagacaaggaagctgaggtctccaaagaatctgaagcctccagcgagccaaaggctgacaaagaagaggagccagaatcaccagatattcatttcgatcctattgtcaaactagaaaaagtggaagtgaaaacactcgaagagaatgaggaggtattgtacaaagttcgtgctaagttgttccgttttgaccaagaaggtaaggaatggaaggaaagaggtgttggagatgctaagttcttaaagaacaaggaaactggaaaagttcgtcttttgatgcgtagagacaaggttctcaaagtatgcgccaatcacttcatttcccctgacttcaccttgaagccaaacgtcggttcagaccgttcatgggtttactcagtaaccgccgatgtttctgagggtaagccagaagcccaaacttttgccatccgttttggtaacaaggaaaatgctgacggattcaagaaggaatttgagaaagctcaagagattaacaagaccaaataatgaatgctaacaattgtgtattatcctatttcccttttcctgcgaatttgttttgctatattcttgagaacattactgattagattggtttttctctatttcttgtgttcccggtgggattgttccttaatcaggttgatttttctttctcttttttggtctctttcttacctctgtactttttcctaccataagttctattgaaactccattttaaaagcaatagacacatttgcattgtaccaaactctggccacaatgtgtctattatctcaatatcacaatgctcttgatgacactgccacaacagaaaatcactgatcctacgaactccagaacttctgattagcaagtctaaaggaggttgatcgcctgtgtacaggttgtttgtgatcatgtcctcggtgatatcaccgggctcaatgagtcctttcttgacgttctccagtatattgactatggttgtcgttatttcgtgtctagatgtatacgagaaacaaacgtttagcacagctttcgagttattggctgtagttctttctgcttcctccagacattccaccacatcacgaggcaacaacgatttgtctccaagagtacgtatcttgatcccatatttttcacacaggtcacctttttcaatcatctgaccgaatctcatcttggctagttccattaaccaatcaacctcgaatgaattccgtttatagttttctatcgaaaaggcaaatatcgttgcagacttgaccccacatttgtaacacacttgaagtaaccttgcgagactttcaaatccagcattatggccctctttcacttcgatttggttaatacgagcatatctcctgtttccatccataataaacccaatatgctgaggaacgggtcctgtgcgtacaacactagcaaataatgaagtacaattctccaggatctgttgatatcctgggaacgtggacatccagtcgggcatgacgtgtgaatactattgctactggtaatactggaaaaatatcactggaaggtggaacctgagcgggggtacaattggagacagctactattcgcgcatagtgaactggtaggaggagagccaccttatactccgcctagcggatttgtgagccacacgttccatccctgcgagcatgtactctttacagagtctccctcaatttttcatcaggttccaaatgatgtctgccagaataccatgggtcctacgacaaattcgtcaccaatcatcatggcaaacgtctatcaaggctgctgaagacatggttcgtgtggaagtgaaaaagcaagatcctttttccattgtatcgaacgaaatgtcgactttggcaaagaacattgctagaattgtgggatcaggccaccctaccctgaatagagtttcatcctactacttcgaagctgatgggaagaagatacgccctttgatagttctacttctatctcgtgccgtttcttgcattccagagtccaaaagaaaccggattgaaattgatcgttatgatgtactggaccagaaggaatatgaagggacccccaagtccatgctatttgcaggcaagtctgctttggaatccatatctcctttgaacattttgcatggaatcaatccttctttgattttgaatccgctgaccagggctaaccttccattaccagactttgaagactcagctgtcaataatgaaattcttcccaaacaaagaagattggccgaagtagtagaaatgattcatactgcttcattgttgcatgatgatgttattgatttttctgactcccgccgtggaaggccttcaggaaacgtcgcattcactaacaagatggctattcttgctggagactttttactaggaagagcctcggtagagcttggccgactgcgtaattctgaggtggttgagctaatgtcaacgtctattgctaatctcgtggagggagaattcatgcaattgaagaatactgttctacaaccggacattaccatggtcgaaggaaatcctactcctattccagaagctactggtaaagtaccaacagagatcagtgaatattcagttcctggtgccattgttgatggtaaacgaatcatcactcatgaagagaacgtaaatgccgctttcgactattatcttcacaaaacttaccttaaaaccgcagcattgatttccaagtcatccaggtccactgctatcttagcaggttgtcaagaagaggtcatcaacaattgttacagatttgggcgtaatcttggtttgtgttttcagatcgttgacgatatgttggactacacaaccacagctgaacaactcggcaagcctgctggtgcagatctccaactgggcttggccacagctccaattctctatgcttggaaaaatgaccccagtctcggacctctgatagcacgtaatttctcaaagcctggtgatgttgagactgccaaaacggccgttataaagaatgacggggttgagaagactcgtgtgttggccagtaaatatagagatcaagcacttgaagctttacgaacgcttcccgaaagtggagcccgttcggtattagaatttgtgactaacagtgttcttactagaaccaaatagattagctgttttgccctaatgtacatagatcttgagataaatttcacgtttaaaatcagcgtacctttttctcgatatcgcatctccgcaaatttctctaaaacaagatagtgcccctcaagttgatgaggatcagactacgagctgatttggggtttaatacaggcagacatacttgtcctttaacgtttaaagagtttagattggtattatcgtctggctcgtcaagattatttagatcaaagactagatttattcatacaaagatgacctcaaaacacgagcacactattgtcagtttcaagaccgcactggcttggatcaatagtagacaaacaactttgatttctctggattcggaatggtttgaacgaaatagcaacgttgtcactgaagttggcatcagtatctacaaaccctacatacctcttgaaggtccagaaggtaagcatttgcccgctccattcctacccgacatatccactctacattttatagttcaaggcaccgaaaaagttcgaaacaagaagtttgttcctgataacaaggatttctttattggtgggacttcatttactgtctccaagaaggacatttctgctgtcataaccgagatagtctcacagttcgagtctactgatgaccaaaagtcagagaaatttaccatgaaatctcctcctccggttgctttagttgggcataatctgataggagacctcaagacactgaagaatgcgggtatcaccattcccatacttccaatcatagatactcgagaattatggcttaatcaagtgaatacatcaaagtcaaacttaaaatacattcttcgcaggcttggcttgccacatagttttcttcacaatgctgcaaatgacgcttattatacccttttggcatcgttgaagcttgcacaaacgaacgtctcacttaatcttctgtactctgaagaggagtgggaaataccaagaaaaacatcaaactcgaatgattttcccaaacccctaccacaagatattcatcagctgcgagataggctgatcaggagcaagctcgtacgagaagaaacaaaatgacaaaaaaaatcctatactatataggttacaaataaaaaagtatcaaaaatgaagcctgcatctctcaggcaaatggcattctgacatcctcttgattagaatctagcaagaccggtcttctcgtaagtgcccaacttgaactgaggaacagtcatgtctaaggcctcaccagagtatcctaaatcttctccaaccaaagtggcagtcttttcaccgatcaaaagagcggtggtgtaggtgttacaaccaacattgtctgggcacacggacaagtcaccaaccttcaagcccttgactccgtaaacgttggatctgtggtccaaaacaccaccccatttgacgatcttggaaccttctcttggaccgatggaacaggttcccagacagtgccatgtggtctcagtgtgctcacgaatgtagttctcaatggccttgtcatcctcctcatcgtactcgatgtctggatgaagctcgacctggttcgaagtaacgtggccttcgttctttgcagttggcttcttcaaaggttgagtccaagaaccgtgagcaagaccagcagacaagttcaaaggtccaccgtaggcattagaggtctccaaatccatttccaaggctctggcctcggatgagtatgggaacagagggtggtgagaagtgacctcaccggcaaagtggtccattcttctagcggtttctctagacttcttgtaagcccaaaccataggagccatgtctctttcatcgttcatgaaacctgggtcgaagtctggagctgcgtatgggtctggggaggtaatgtgaatggaacctctggagaatgggtattccaagaagtggaacatagtcatgtactttccaggaggaatcttggtgtggtcaccgaagaaaccagcaatgatggagtagtgcataactggcttgtctggcttgtcttcgaagtattctctgtaaccctcctggaaggattcgtccatttgagagagttcttctggtgttggtctgatcttgacaccagcttcgataccgttagtggcaagaggaccagtaccattggcgtaccattggtcaaagactctcttttgaatctcagcatcaccacggacgaagtcatcgaaagactcgtactgaggcttgattctgtaaggactgaagaaacagtagtggtcttggaagtttcttccgacacctggcaagttgaccaaaggcttaacaccagcggctctcaacttgattgggtcaccaaaaccggatctttgcaaaaccaatggagaggagatggtaccacaagacaaaacgatttgctttctagcacggtagatcttgtgacttggcttctttgggttcaaaggcttgcttggaacggttctaacagcagcagctcttccgtcttcgacaataattttgtcgaccttcgtgttacagatcaagtacaagttgtcgtggtttctcatagtagagtggacaaatgcatgagcagagtcggaacgacgaccagtgtctctgttgatccacttcaaccagtgttcagcaccgtgagcagtaaccaagtcttccaagtcgtcaacgtatggaataccttgggactcagaagccctcaagaagtcctggcaaactgggtaggtgtagttaccgaaagaaaccttgattggaccttcgaaaccgtgaatgtcagggttgttgcaagctctttggtaggtctcagtctttttcatcaatggaagcaagtccttggttttccagccctcggcttggaagtcatcgtaatcagaagcagaacctctggtgtacatcatgaagttgatagaagaaccaccacccaagacgttagcacatggaacaatggctcttctaccattcaagtgaggagatgggttagaagtgtagaaggaagcagtcttggagtccaacttcatgtttcttgggtaaatacctggaaggtagacccatgggttgttgaggttgttctcacctgcttcgataagaccaactttcaaggagtggtccaagtttgccaatcttccggcaatacaggatccactggatccaccacctagaactaggatatcaaactcttcggggatagccatcgtttcgaataattagttgttttttgatcttctcaagttgtcgttaaaagtcgttaaaatcaaaagcttgtcaattggaaccagtcgcaattatgaaagtaagctaataatgatgataaaaaaaaaggtttaagacagggcagcttccttctgtttatatattgctgtcaagtaggggttagaacagttaaattttgatcatgaacgttaggctatcagcagtattcccaccagaatcttggaagcatacaatgtggagacaatgcataatcatccaaaaagcgggtgtttccccatttgcgtttcggcacaggtgcaccggggttcagaagcgatagagagactgcgctaagcattaatgagattatttttgagcattcgtcaatcaataccaaacaagacaaacggtatgccgacttttggaagtttctttttgaccaactggccgttagcatttcaacgaaccaaacttagttcatcttggatgagatcacgcttttgtcatattaggttccaagacagcgtttaaactgtcagttttgggccatttggggaacatgaaactatttgaccccacactcagaaagccctcatctggagtgatgttcgggtgtaatgcggagcttgttgcattcggaaataaacaaacatgaacctcgccaggggggccaggatagacaggctaataaagtcatggtgttagtagcctaatagaaggaattggaatgagcgagctccaatcaagcccaataactgggctggtttttcgatggcaaaagtgggtgttgaggagaagaggagtggaggtcctgcgtttgcaacggtctgctgctagtgtatcccctcctgttgcgtttggcacttatgtgtgagaatggacctgtggatgtcggatggcaaaaaggtttcattcaacctttcgtctttggatgttagatctcgaataataactgttatttttcagtgttcccgatctgcgtctatttcacaataccaacatgagtcaaccaaatccaaatgtcatcattgtaggcgctgggatttcaggcatcaaagctgcagtcgatctcaaaagcaatggcgtgaatgcgttgattttagagggtagggaccgtattggaggtaggttggttgcgactcatgaaacctcagtctcattggatttgggggcatcctggtttcatcgtgttcctgacaatgtcctatatgagaaagttatcaataaagaatacaagtctccggttgaatttacctttgatgactcgaatgtcaaaattatggccaagccagtagatttgttgccattttggcagtttgtcaagtcccagcctcaagacgacaccttacggaattttgtttataagtacttgcaaactacaaagcttaatgaagttgatacccaagattttattaagtttgttaggggtacctctgagattggtggtgctggcaattggtgttatatatccggtaagaatgctgtcccgccgtcagaaactcaaggcagagatgcctttgtcaccagcacatatgcccaaattctacagcaagaagcttcttacttggacccctttcaaataattacatcgtccaaggtcaccgaaatcatcaaaaacactgccagctcaacatatacagttaagacctcatccggagttacttactccgcagactttgttattgtgacggtgcctctaggggttctcaaaagtgatgacatttcatttactcctccactccctacatctatttccagccaattgaacaaagtccaaatgggaaacattgcgaaagtaatatttgagtttgaaactgttttctgggatgaaactgtggacaaatggcttttgtttcccgaaacacatccggaagagggcaacaaatttggtcatttgcctttagaatatgaaccttcctcaagtgaattcactgctcttgtttgcaacattttcaaatcaaaaagtgctaagatcctagtgacattggttagcgctcccatagctatataccttgaggctcacccccaggaagcctggaaccttttgaaaccgatgtactctcagatttctgcgtgcgacgaatccgagattcctaaacctgttaagcaggtggtaacatcctggtcgttggacccatttagcaagggctctgtttctgctacaggtcctgaggatattcccctcattaaagagtttatacaaggagtaggaaacttgcgctttgccggggaacatacaagtgatgtagccaggactcaagcccacggggcttacctcactggtcaacgagaagccagctttattattagagatatatataaatgttgaatgtagattaatagttttctcctaattgctctaaaaccctagccctggtccgttcttcttcctcctgcgaaacttttacctgaaaaaaccccctccattcgtctacattgaagttccttgcccaagggagtcccttagccattccactgtcttcgatgtctagtctgcttaaaaattgtttagctgcacagttttccaggaagtatgctgggaaatcactctccaaccacatgactcgtctcagtctgagtacctctaacttctggagggctagtaaatttgcgattatatccttctctgtgaccttttcccaaacatgcagcgtcgaatcaaacattgaatacacagtatcggacaaaaatataggcttcccatctaccacttgttgcttagggtggtccagtaacatagtcgaatgcacaggtatcctattagagccccgtccggtttgccaatcaaaagtgctaaacgataggacttggtaatcatgactcaaagatatgccactgaagtcaacaaacttgaggttgggacacaattgtaagagatggatgatatagccaataggaatatccttggagcaccagtagttactaaagaaactattctccaaagggtgaggtgtcgaaaaaggctttctgttgtctgtgtgtttttctggtagcttctttacatagttcactttgccgggatccttctcatggttctgagatagtttgcggaattgcgatttcaacttattgaatagcctatcgctttccttcgccgagcagttagtataagatctccccaagtcattggtaaaaggtgttgccttctgttcatacagagaagtgtgagataagcgacgttcgtttgtggatcgacttgaagaggtagtgaaccgggcaccatagaccggatgatcacgaaatttccagtccctccatccggctaacggttccaaatgctgattccttagtgctaagtctttgatatagtagccttcatccgataaatcaacccctggccttactttcgacagatctaagctcttcaagtggagtgccaattcctgatggtttaacaaagtatatacaaattgagcaagcctgtaggtggaagtaatgtaagggtctctgtataatactggggtaacagcggccttcaatttcttagaaacgtacaagcaatgaatcaaagtaattctgtcatcgacgtaggacataacaatggataatacttctgtcggtaacgattccagtgactttggaggggctcgtacgtttgatatagtgttcatggtagaacggatagagtggatagaaaatgaatccgaagtagaactcatcaatttcttcctctttgtgttgattggctgcaacagcgacttgtacttcatctggaaccttttcttggtgttttccttgaccaaggagagaggataatagccactagggaaagacaagggaggatcattctcctgactgtgaatcaattgatgagtaacataatcatactgcgtattcggggataacaaagaacgataaggtggcaaatgattctgataatagctcaggtaatctgtcatcaaatttgaaatatcaactggtctttgtttgtaattgttatcaggttagctttcttgatcgtgatcagtgaatagagtgatatgtgggatatctgtggtgcaaggatgttctccataacaacatatactaattgttattgctacgatgatattcaaggtaatagtactgctcacagctcggatgaacgaactgttcatgctatacattggcgctctttgtgtgttcttggcttgatctttttttggggctattttgttccattctatgctattttttcttgatttttattcactattactggtcacaatacattgattatgtaaggggcttgtcatctgaacgttattttgtatacaacatagggagaccatgcggggagcagccctttgggaaaaaatcgtacattcggaaaggcgcactgcactgcacagtggaaaacatatggagtgtccccgtttgtctacggcacaaaggattggcaacctagagagagagagagattctccactcaagacagtaaatagagctgtcgtgattggctagggtttacttaaattgttaacaaactgtcacaccttagttatcttgagttaaccagcagtcttggttattacaattgtgtgatggtgagtaatgtggttcaaaagggtgagttttcctagggaaaatactggcaaagacacctaagaactacaagatatataaatctgttagaaaaaggacacctaaataatgaaagactttgatcttgagtggccctcctgatacatatatcaagatagaggggcatcatgatacaaattgtatctgtcgaaattattcgacctttccttttagtaactcaagtcacgataagtgttagcatcatcaggtgtaaggattaaatcttttgttccaggtcttgatgcatttttcagcccattagcaatcagaatttagggttactaggttgctgcagcttgatacctatatatgttcctattctttcgttatttcttacgttatgtttgagcattaaccttctacttacattctgacattcacagatctctttttttgcattctggatttaactggttcgttttaaatcctgatgttctagaagcccagaaccataccatgcaaaatcgtaacacctgtcgacgagatcattctgtcaacaaaactatacttgctacatcttcttgctcatcttatccaatgttgaggtgtacgcgattaataggaattcctgtttccttctaatgtatcctcccgcgagaccctctagcctccacctcgctcctaccaatccttcgcaccctttacgtatccagatatttgatccacaatcatcgccctcaccagaatgatccccttagataaagagtttgagttgaacaaccaaagagtcctaacaaaacgcaagattgagtacagagcgaactttgttaccctcgtggacatagtatgctatgtggttcttctcacgatatacttcaaagataattcctttcttcgacttttagtacgaacaatagtacaggttgcaatttccaatcctttccctatcgacattccgttgtcaggcagaacaatgccttttaagaaaatgtattctaaaaagcttcttcaggtggtggagttctccaatttactctgtttggctgcacatatcttcatgacacctacccatacacagtcttacacttcgggacttgagaggtatctggatacctacaactatggaggcattgcagttcatttgattggagaaaaatacatagataattggcttgtggaaagagttttccttttattcaacgacttgatgctatttgggttacaatttttgttgttctatgtgacttgttgtgtaaaccagaatgttcttccggaagatggtaatgaggagtgcacagaaccttcagagattgtgaatgaaatagcagaaccaaatgaaagagttgataatccgatccaggatattacagaaacagatacacctatccttctaggtgaggagctagagcaagacatagaagactcaaaagaatacgacggttacaccggcaatataaaacttttcgattgtgatccactacatactatctccacaatcagaaaattcaatagacataacgtgggagacattgaggaaggccaaggggatggaactttgggggagatgccaggtagttttgaaatgattactggcaatagactgcataacattgtatagcatatgaatgaaattaatataatttttagttcatgttcccgatcggacaatttttgaggtattccgctttattcttcaaaattctaacacttttgaagaaaatctcttctggaggcatacagccagtgctttctacgttgaaaatgaaatgatctctttgtcttgccagcttaacttttccttcaaattcagggtgtctcaaacattctcgtgaaactgtgtctcttctagcatccttgactacagcttggccattttcaatggcaatgactcctttggggaaacatttttgaaatttttctgcatctttaccagtgatgggctgtgtaatattaattaccggtaacagtctgtaactggcagtgcaaactggtgaaaatttggcgtgatctgatcccaaccctaagatacagtgagctttcaatgaaatttcctgtcccggtcgtagtttggcgattacaatatcaggatcagcggcaaccaccggagaatcggcaaaagtttccacctgacgaccctgaggttcaaacttcaggtctctagagtaaacgattgagtttctgtataagttttctggatcattgttattctttgctgggtgtggattcttggtacaagcgacattaagtgatattactactgtattttcgtcagtgaaacgttcactctcttccacgcctcgatccacccaacttaggcgatcgggatctatctgcaaaggtactagacctattcttgaggctagaacttcatcctggataactgacgagttattattaatgtaaacatgttcgacagaaaccgaaggtacctcactgatcatgattctacggaacgcattggcaattgatgtatctatgtgtataagatcaaaattcagcgtccggtctgttctgtagccaactttaatttccaaagtgtctttgaatttttgaaggtcccatgcataatcagtattgctgtcgtatcctggaaaatccgtagagctaacattagttaccctgtccttctcaatattgactaagttggacatttctagttcaaagagtactctacagaaaaactacataaaaaaaaaaaaaaaaaaccatctaggctgcgcgaactgggactaaacatccatacattatagtgggaaccctctggctaatctgtaatctcacaaacacatcaacctcgaaggaaaggctttgttgaaccagtcagatggagacagtaggcattgaatcatttggggggacgcttccagaagtccctgagaaggatgctgcaatttcttctccaacaagcgataacagatattccggttggaagggattagacgattatctgatccaatctgggtataatgggtatcaggaattttacgattatatgagtgatgaagggatgacgtgcgatgataatatatatcgggatctgattctaaagaagctgaaagttttaaatccagaagaaaaatgggccaatattattttaaagtacgatcagttagtagccactggcttgaagttcgatagggacgaattggattcaaatgtggaactaaagtttctcctgtttctgagagtaacgaatgcccttaagatatctgatttgttatatgatgattctgatgacaagattgaggatgtatccacggcattgaactccaggatgctcagtctcacagggttggcaaactctcctcatgaagatcaagttaaactagcattgatcaaactgagccatattcagtcggatataccttctctctttgttttgaaaactgctgattatctttgtactctttcaggggaccctgagctcaaccaagctttgatgaaggatgctttcaaggtcttgtttgctgtcaacttccagttcaacaattattttcaatttgctggaagtgatccgaacgaacttttcaagtttcagctactaagagtgttagaagccaattgccctaagctatttggaaaattggtcgaaaaattgggcgacaatctgattgatttcttacaggaatgggttaacgaggattccttttggataaagattcttgaatccgaccatttttctaatgttattgatgatataattcttcaaagtttcaaagttcttgtcctgtatattgtccaatctttgtattcgactcaagacgttatcatagagaagttgggaatactaaccgaaaaggaagaatacattcaacttctaaacgagtttatctcgatttccgagagttcttttaccaatttgagtttccagaatttgttcacatacgaagccgaatttaactctcttaaacaacccttgagtgagcatatcacaaagaaatcaaggctaatacggagtttgaagaccaagaatcaccaattaatggtgaataaacagaggaaacagacccaattcaatgatttattggcaaattaccaacagttgaacgaagaaaagatgaacaatgagcttttagtagaaaggctgaatcgggaaaattctaatttgacaaaagagatacaagctaaacaagaccagctggacggttacctctcaaattacgacgtgatcaagactaccaacgatcgtaataaggaaatggatcttatgaataatggtctgaagaaagatatggagcaaatcaccaaaaagattcaggagctacaagtaaaactgaaaaggtaattagattacagacttatcagataattcaatttccccggcaaatctcgtgtttctcatttctcttggcaagatatacattactcttgtagttcgtacctgaccgagttcggtcatgcaagcaactattgcaattttcctgtttatgtacccttgttgcttaggtcactctaaaacccttctttcccggaaaaaccttccgggaaatctctacagattgccaagtcggattaataatgtgagacgttatgtcttagcatatatataagcctccgtgaatcatgtatagccataccacccatatctctattcttgaagaggcttgccggcttgccgtgaaaatacttttatttgtatttgtttacttctttcatacgtggtgaataccaaagacaaaacaagcaactaaaattatttttccagcatatgacgtctgacgtcatcatatcatgcacctcccccaccagctcgccttatttttatgtcctccacaatcagatatatctgttttgccgaacgtcttgtagtaatacaattcagagcagacttggcgggataactagctctagttgacaaataaaagaattagttgttttcatcttggagagcaggtgggatctttttccgtgttcatttacataaattttaaatacattaaggttcgaaaaaaaagccaactccagaaaaaatgattccgtgcgcatttgaggaatgtctgaaacagattgcagattgcattgtctccgcaataaaaataacctgtaaattcagctgtataaaaaacccccgttttgctgtcctctaccctctctattaaagttttatagacatgtctaacactaaagaaacaggtttgtttgaaaccggttcaacatcatcagaaaacgaaaagcaatccatttcagacaatgaaatagcagaaagcttagatcagcaaaatatcttgacacagtacagtgaagaagacgttatgtctatggggagaaactatgctatcaaacatggtttggaccccgatctgtttgcaaaaggagctgcgattgctagaaatcccataggttacaacagaatggagttcctttctcaggaagaaaaggagattttatatcaggaagagcaccaaaagtggaaacttcccaagaagctttattatctgatcataatggcttccatgggtgcatgtgtccagggtatggatgagtctgtcatcaatggtgcaaatttgacttatcctgcaggtttgggaattggtagcgacagtgaaagggactcttggctgcaaggtttagtaaactcagcaccgtacatatgctgtggtctcatatcgtgttggatgactgatgcctggaacgctaggctggggcgaaagtggaccatcttttggacatgcttcatctcagctattacctgtttctggcaaggattctgtaatacatggtaccatttgtttatcgcccgtttcatgctagggttcggaattggaccaaagtctgcaactattcctgtttacgcagcagaatgtgtccctcataaaatcaggggagcactggtaatgatgtggcaaatgtggacagcttttgggatcatgctgggctacgtgttctctctggcatttcataaagttcctgaccatggaattggaggaggtggtttagcctggaggttgatgcttggttctgccatgcttccagcaatcgtggtatgtctccaggtttggtcctgtccagaatctccaaggtggctaatgggtaaagaaagacatgccgaagcctacgaatctttaaaagttttaagaaaccatcctgttcaagccgctagagataccttctaccaaaatgttttattgatggaagaaaactcttacacatctatgggtttctttggcaagttgaaggaaatggttgtcgtcagaaggaatagaaatggagccatgggcgctggtattgtcatgtttatgcagcaattctgcggaataaacgtcattgcctactattcttcgtctattttcgttgaatcaggattcactgaaacgtcggcgttattggcctcttggggattcggtatgatcaactggctttttgcgcttccagctgttttcactattgatcttgctggtaggaggacgcttcttctgattacctttccattaatgtcaatgatgctgcttctggcagggttctctttctggatccctgaagaaaatgaaaaagcaagagttggtgttgtttctcttggtatttatctattcgcagccatctactcttctggagaaggtccggttcctttcacatactcagctgagtgtgccccgttatatatccgtgatgttgtgatgtcatttgctactgcaacttgttggttcttcaacagtgtcttagcactcacttggccttctttgaaaaatgctttcaaggtgcaaggtgcatttggtttctatgctgcatggaatatagtaggattctttctggtattgatgttcctaccagagacaaagggtttgacgctagaagaactagatgacgttttcgatgtgcctacatggcagcatgcttcatatcagttgaaaaagatgtggattaacattcagagaaatatcatcaggaaggacgtcgaacctatgcccccgttgtacaaacatcacagaatggctcttactaatgctcaatgggaagaaaaacacgaagtggaacttgttgaaaacgtctagtttgttgtcaactatcgtaatttcattaaactgtatcaaatactttaagccaagataaatacttaaaccactttggttccactaggacacattgcgcagtagcaattttcgtagactcctcttgcctgtcgttataagatagcgtttcaatatttcccttgattatgcattttcttcccttcgcttccataagctggccctttagaatcactgtggatccaggatccactttgttctcaaaattgattgtcagttgggccgtcacacccttaccactaggcaatttcttgaatccacatagacacaactgttcatctaaaagagtagcaatcagaccgttgtgtatcttattgtcgcttccaactaggtcgcttcccaattggtagaaaacacgaattctaccaccttcttcatctaaaaacacaattgggtctatctctaaatgtctctctccagccataatcccctggctcacatgatttttcaacatttgttcgggtaaaatttcactatgtgtgattaacttgtaaccttcatcctgagcgtacgtctgaaatgctttgctttgccttatactttggattacaacatcgttattgaatctcttcccatacttgaaaagattcttttgtctttctacgtcaaacattgtgaacgaagtgggccatggcctcaccattgttacatatcctcctgcaaagaaggtaccggcgagtagaattctggaagcagctttaaacatttgatttattaagatgagggggtggagaggacatggtgaaatcctggtctaaaagagttcgcgcggtgcaagacagaacttgagtacgtcgcttctagtcccttaggtaaaagaactacgcaacgaaatgcgatacaaaagatttgtaactgtatacaggaggcaatgaaattaaattttgagccctcttttgagcccgtataatatggctacagaagcagataaaattgtaaccccaccgaatatggaaactaaacgatgttgattagcttcaatttccagggcctcgtggtatggtatatcgtctctaaaagataccatggtgtataaaggcagccagtgatcacctagtagtttgtgtaaaaaaccgtccgttgctttccgcagtttatacaagtttgatgtaactttggcagacatttcatggtagttagccaaggctaaactcagaatagctaacaaatccttgtgcctagtttcagtgaatgcctcaaacgcgtcttcagagacatgtttgtattttttgagaagctcagttaaaacacgaacgtcttcgaatccgcaattcataccttgaccataaaacggcaccatagaatgcgcagcatccccaatgattatacactttcccttaaaatgataaggagaacatgtgacctgtaatagagatcccttaggattattttgaaaggcacgcactaggcttttttcaccaataaggttcactgcgtcagggaactggtcagagaaaaaagatgaaatttgctcctcggttctcagagactctgttagcttccagggaccaaaaaaagtggacgtaaacgatccatcagtgttgggtaacgcaattaacatgaaatctactctgggccagatgtgtagatggttgggagaaatggaaaacttgttgcttggatcatcggatggcggaatgtataactcaacgtaacacttgtctatatattgtgaagaatagtccatccttactttcttacccaaaaaggccctcgtaatagaatgagctccgtcagcccctatcaccatgtcaaacttcaaatgaacatcgtcgttggagtttttgcgcctgaaagtaagttcaaccggagaatgttcatcgttgtcgttaccaaaatccatattaactaacttgtgctcaaactttgtctggatagagccttcattttttgcttcatcaaacagttcaatttcgtgcaataagttctcgttcaacactcccctatcaatagagtagatagcatcaccgtaaagcccatataactgctctgcttggtttcctttcaaatcgtgaatcatgcggcctttcattggaagaacatctgctaaaactcgctcagccatctgaggatcaatcattctcagggttctgatacctcgattactaactgctaaattaatagatctcaagttcttatcctcagtatctgctagcctaggatccgcacggagctcaaaaatcgtcacattatatccttcatgtgctagtgataatcctgcaactgctcctacgagcccagctccaataactgctacgtttcctttcattaatagtcaaaagagtagaggaaagttacatgatgtgactctagaattattctttctcgaatagagggaaatgataaaaacgattagatgttggatgtaagatgatggttttggcgtgtcagccaagttactttatattacttctattttacttcaaaacaacttcaaccaccaaatcgcctccaagggctactatttcattaagcgcactttctttgttaaaggtcacatgctctgtttcctccacaggtttacagttgtaagccgatgacactttgaacttcctctttgcaactgtggaagggttgaataatccagtcacgacattcgatccctttttatttaaactggtaaatctcttggtagaaaagattatttgacccttgaatttgtcattcaactcatccacataccattggataggatccatcttagaggtaatatcatcaggataagaagttcttccgttaaccacattggcaaaaaccttggcctctgcaattccactagaggatactagatcttctgtctggaccttaatcacaaagtcatagtctgccaaggcaggagtaaacagtagcttgatgcttttatgattcagttcacctttcattaccaaattagtggctacttttgccaagctcgtcaatctggttgctacaggtaagctgatatcattggtccataatataccggaattgtcatcctttgaaccaacaaaaaactgcattttcatggctgtggggtccgttttacgttgcttgtcaaaatttgtgttgatgagctgatatgtttgaacgtctaaattgtctttcaatttgtcaatataacttgtgccattctcggtagtagggtttaagcttgagtcgtctactggttttgacaaatctaagatcagtggttcttctttccaattccattgactcaaaaactgtagaattctaagaaaccctgattcgacactacttggaactgaataaggagctgggtccacgaatacttttatggccagaagttcaacgaactcttgaggaaaatgaactgacaacagctgcgagtccatccacctcttgaataatcgaactgtgggtgagaaaaaagggaaatggaaagcaagtgtgttcattgttctgtggtgtttcatggatccaatatatttctgagtaaatcggaggtaagtatctctaaggatgggtctttgtctgtggtctgcattctcgatagctctcaaatataagatttcgtcatgttctgtcaatactcgtattctaaagccgtatccttgtggtgttaaaatgtttaggagggttactgcgtagtttaaaggaaccgactcatccttagttatgaaaccttgataatttgtttcaccttgcaaaacctccaaagttcgaatcaagaaagaactcttagttttttctagagaaatcaattcatctggccacttagtagaggattcaaattgtactatcacctcattgaaaaaatctggattggaaacagcaaatggaacaggctggagtaacgaagtcgcacgcaagcttggcgaggcaggattaactgatttgattcttaatggcaattccaaactgtacaaaatcttgcataattcatcaaaggaattgttcaaattttgaaatgctgcagttgagattattgattgctttgtagatgctggcagggaaggcaatggcacataactctgaaactcggagatattgctgactaagtggcttgaaatgcttgtctcggtattagatgacagatgtaaatcgaaaagaaattttatgatcgacaggactacaggctctgacgatgagcttgcccatatgcaacaattttgaatggtaccatctttaaatcttcgcaaagaggccttcgactgccaaaactgtctgaacttcgctccattgacctcgtcttcgttgtccgggcctttagtaaccaatctctcgcattccagtggattcaacaagagtccaatgactatgtttctaccctcggaaggtcctccggccttacgtttatgaattgagaatgtcgttatcaagttttctatccaaatggagatatccgtaacacggtccattaatcctcttttcaaaatggcgtatatcttactctttatgaaattctcaaatgaaataaatgagatcttctccagaggaccaaaatttttctcatgatccaattctgccaatggtattttgatcgttaaatcgtaagttaagctgggtgttctgcattgttgcaaaaagacggagtcaaatctatcatacactaaatcattcaaggccacaagggtctgctgtgcatgtcttcgtaaagtctcatatgaccatttagtggttttccataagatatttatttttgtgttcttatcgaaaattgtgggaacatggaacccatcaggcttgtatttagatgacgtctctccaatagcagaagtaaaagaaagataaccttcgtccataagatcttgggtcgctaaatacttgatcgttcccttgaaaagctggtagcttgaaaatccatgtaacaaaatcttgttactagtgagtccacctccttgtaataatgcagtcatcagtatggcgaactcaaaatgaccaaatccaccttcattgaaatgtgacgaaaagcctctttgtcgtaaccatagttttccaagtacacaagcatccctaaagctctctgtggttttctttgctgtatacaacagctttaagtagtgcgaatatgttgtagaagacaaaagagaagaattgtacaatggagttggggtgagttgtatactgtcgtgatcgccatacattttcgatccttgatctgttggagactgaacttttatgcaattcttatctggaagtagtttctttccttcaaagagacccagttcaaatcctacgataattcggatggagaacttggttttctcaaaaaccagatgttcaggattaggttggtctggagtgatgctttcaacgcgtatagctggacatagtttatcaccattaacatattcatatgatatcttaatggggaggtagtgctcttgggatagtgttacaagttggtcagccaggtagccaatataaaaggctctcttgtgaaatgcacgataatttacatagtcctttgaatgaaacaattttgatggcatagtaattgacatatcaatgacactgccttctggttgtcgaatggcagttttcagaccaaaagatccaatcaaagacacatcagagggttgcaggaatgaaaacttatagttaggatgaaatggtttaggatcggggaaaggcacggccaccttattgctagaaacgtgaaaataagattcaacatctttcagcgtcaagttttccacttctgggacctgctgaatgatatggtgtaacctgtgtaatactttttctatcactttgatgtgagagtctttgatttttaagttcttcaccaattcatcaatctgtaatttgaaaatgttagacttgaataactcggctgtctcccttgctatctgaatatcctgagccgaaaggttcgccacagtggacttcttctgccggggttcactcgtaggttggtccgcatcatcttcataatgaaccatctgttgagcaatctctgctgtctgagcagaagctgactcattatccgcatcggaaatgtgtgattccccattggataactcatctattcttcttttactcatgatttagctgtgactaggttgttagtacctctctcacccttcctaaaggaaaaaaaagttttgaaattttttgcgtggtacagacaagtttattagtacagaaacatacacagtgatcagcgtacattgtggtcttaaatgaaagataggagagaaaacccgttatgtaagcatttcgagggtccttttattccggccgctgttttacttatctcctaacataagatcggtttatttttaccctatgccgatatctttggagatctgaagactgatctcggctgaataagaaggttattgataccgacagattacccaaacttgaccgaataaagttaccacagagtaaattttaccataatcactcatattcatggaaagtgcaggaaaatataaaagagagtggagctgccctctgtaagacactcttgcaaattatctgaaacttgcatcaatatgtcttcgacttcttcgtcaattaatgacaaagacaaggagagctccaatattgactctccgaaagatacggtgccatatgagcccactagatttgtaggagatttggaaaatcagaatgaagatgacatctactctgaacagttgtcccggattttgacacagagcgaagctgttcagaaaattcagtctttggctagaacaatgagtcgaatgaccaagaaagagcttgcagcctttgaggtcaaccaggatgattttgatttgaagatcctcctgcattatttaagagctaaaagtgaagagcaaggaattgagtcttgctcagccggtgtggctttcaagaacttaacagctactggaattgatgtgtccgcagcctatggacctactgtggatgaaatgttgcgtaacttttttatgtggcccattagatttgcaaaacgagaacatgtcaagactagacaaattatccgtaactttaccggatctatcgaagctggtgagttgtgcttggtcctaggtagacctggtgctggatgttccactcttctaaaatgctgtaccggaaacacttcagagttgttatctgttgagggagaattctcctacgatggtctcgaccaagccgaaatgatgaaggactacaaaggttacgtcatctataatcccgagctggatacacattttcctcatataacggtgaaacaaacaattgattttgctttgaaaatgaagactccagccaaacgagttgacggtattcctagaaagaaatacatcgacactatgagagacttgtggtgtactgtttttggtttgagacatacttatggtactaaggttggtaatgatttcattagaggtgtttcaggaggtgagcgtaagagagtgtcaattgttgaagcactcgctaccggagcatctgtgtatgcatgggataatgctaccagaggtttggatgcttccacagctttagagtttacgcaagctattagaacctcaactaaccttttgaacgcttctggtatggtagctatctaccaagctggtgaaaatatttatgagctgttcgacaaagtctgtgttttgtacaatggtaagcaggtttatttcggtccagctgaaaaggcaaggaaatactttgaggacatgggatggtacaagccaccaagaatgactactccggaatttttgactgctgttactgatccaagtggtcgttttatcagagaagggttcaaaaacaaggttcctgaaaattcggaagatttcgaacaatattggcttaattccccagagtatcaagaatgtttacggagtcatgatcaatatattcaagaccacaaccctgaagagacgaggcaacgtttggccaccgccaagtctcaaactaggcaaaaagctgtaagaagtaagtccagatttgttgcctcttatcccaaccaaattgcttattgtgttacgagaggttttcaaagaactaaaggtgagatagcgtatacgctggtttatctctcatcatttctgaccaagggattcattgtcggttccatgtattggaacattccaaaagacaccagtggattgttctcaagaagtggtatcttattttactgtttgcttttctgtgctgttacctctctttcggagatctctcacacgtacactaaccgtcctatcattttgaaacagaagagttattctctgtatcaccagtctgccgagtcattacaggaaattatcactgagctacctacaaagcttgtggctgtcatcattcttgcgctgaccacttacttcatgcctgggttgcgattgtctgacggaggatccgctttctggatgtacttactgtttttacttttgattcagcagtgtatgtcattcatgtttaagctgattgccactcttacaagagacgcgggaactgctcatgcttgtggaggtttattggctttaatgatgtgtgtttacacaggatttattattcctttgccttatatgcaccattggatcaaatggttcaactggattaaccctatgagatattgttatgaatctttgttggctacagagcttcacagcagagaaatgaaatgtagtgagtacattcccaatggtccagactacgaaggtattagtatggagaatagtgcatgtacaactacagcttataaccacactactggtcttgtctctggtaatgccttcctgactgctacatataattaccgatacagtcacgtttggagaaactttggtataaacattgcttggactgcaggtttcatcattattaacacaattctatctgagtttgtgaagaatgtcgaaggtggcggtgatatgcttttgtacaaaaggggacacatgcccaaggaaggtattgaagccgttgatggtaaagtcgccagtaagcaagaaatgatggaagcactgaatggacctgatgtcgatttgaagaaagttatcgcagaaagagatgtcttcacttggcaacatctggactatgtcattccttatggtggagcaacaaggcaactacttaatgacgtccagggatacgtcaagccaggtacaatgactgctttgatgggagaatctggtgcaggtaagacaactcttttgaatactctatcgcaaagaattaactttggtaccattacgggagacattttcgtaaatggcagacctctagattcctccttcaaaagaagaactggattcgttcaacaatctgacttgcatttagctgagtattcagtacgagaatctttgagattcgcagtcaatctgagacaatctgaaaaggttccccaagccgaaaagtatgaatatgttgaaaagatcatcaacttgttgggcatgcagaattatgctgaagctatcatcggcaaaatcggacgtggtctgaatgttgagcaacgtaagaagttgtccatcgctgttgaactggtcgccaagccttctttattattgttcttggatgagcctacttctggattggactcccaatctgcatggtccatcatccagttcctgagagccctgtctgactcgggacaggccattctttgtactatccatcagccttcagccactctatttgaggttttcgatcgtctattgctactgaaaaagggaggaagaactgtttactttggtgatattggccccaactcttccactatgctttcatactttgaaagggaatctggtattaagtgtggagtatccgaaaatcctgctgaatacatcctgaattgtatcggagctggtgcaactgctcatgcgtctgctgattggggtgatctgtgggtatcatccccagaacatgctgctgtcactgaagaaatttctagactgaacactgaattacagaagagaccattgcctgagaacatcgaagacttacaatctaagtttgctactagttaccctcaccagattaagatcttgttcttgaggacaatggttcaattctggagatccccagtttacatcagagcaaagtttttagaagctgtcgtttgtgcaatttttgttggtttttcatttgtcaaagttggtcatggtttgcaagaggcacagtttggtctaacatcaattttcatgatgctaattatttctcttgccatgattaaccagatgcatgtttttgcctttgactcccgtgaactatttgaagcaagagagagcgcatcaaataccttccattggtccactcttttattagctcagacttggtgggaaaccatttggtgtatggcatgccaattcttgtgttttgtgtgttactatttcccggccgggttcagcggtactgctcaccatgccggatactttttcttacaatttgttataattttccctatctattactgttcttacggtctttgggtattatatttctctcctgatgttccaagtgctggtatgatcaactcgaatttctttgctgctatgttactgttctgtggagttcttcagccacctcagttcatgccaggattttggacgttcatgtacaaattgtccccatacacttactttgttcagtctttcgttgcaccgctggtccataacagaaagttggtctgcagaacgaacgagtatactttaattacaccacccgagggccaaacatgttcagagtttttagacccgtttattgaatctgatggaggatacttgggaaatccggatgccacagagagttgcgagtactgtccatatacttaccagtctcaagtaatggaacaatttaacataaaatggtcctacagatggagaaactttggattcttcttcgcttacatcatttttaactacgttgctctattgagttgctattacctgatgagggtcaaagtctggaatatgaaatctatcttgaatttcaagaaatggttcaatgggccaagaaaggagagacatgaccctgaaaccaacatcttcgcagctcagcctgctgatgctaaattggccgttctgaaaaagaaggagtgatatagataaccataaagtagattgctaatataagttttaaattgcatccaattacagttgatataccaactgaaacatttatgctccagtgattcttctaagagacaataatttattctgtcctgtcttttttcatttgcggaagggaaggttgatgccaaatcggaagcgcgctaggggaatatctcggaagggatacatttcatttcgctcactagttttactgatgtacccatcgtaattactgaggacatccttcttgattcttctctgttctcattttagtaatgtatttgagaaatttcaggtacgttggtcttcttcagcgatcccgacacgttctgatcccactaatagtgggcaaagcgccgctggcattgttgccctgtacttccagaggctctatccgagcctactccgaaaagaagttagtgaatatttcagggccagaaactccaaagaagaatatttgggcaaaagtcaaacatgaagctcagcattattgggatggtaccaaacttttgggtatggagattcgtatttcttctaaattgttgctcaagatggctactggctatgagttgaccagaagagagtttaaacagctaactcgtacaacaagtgatatcatgagactgtttccttttgccatgtttattatagttccatttgctgaattgctccttccggtggcactgaaaatctttccaaacttgttaccttccacatatgaatccaagctggataaagcgaaaaaggcaaaactcttgagaaaaacaagaacaaaagttagtgaagttcttaggaatgccaagagcagtatcaaattaccttctaatgttaccgaagaggagaaaacgttgtttaaggagttttatcaagcagtgaagtctggatctaatgagcaaatttctagagagcagttgattagagtggccaggatgttcaaggacgacttggttttagacaatttatccaggcccctactggttgccatctccaagtatatcaatttgaaaccctttggaactgaccaaattctcagatacagaatcagacataaaatgctgaacatcaagaaagatgatagagtgattagttacgaaggagtggatagtctgactgcgcaagagttgcaagttgcttgtgcatcaagagggttcaaggttcatactgttccttcggaagaattgcgaaactctttgtcactatggttaaaaatgcgtcttgaagataagatcccgtccacgttgttgattctagcttgtgcctacgattatgggaatgttgccactactaatgagaatctttatgagaacttgcaggcaattctaggaagtcttcctgaggagatttatcatgtcactgaattggatgtggatgatgacactgtgactcataaacagaggcttaatgtcctgaaagagcaggagcatttgatcaaaagtgaagttaatcaagagaaagatcatatcgtcctggttagagatgggctaagtttggatgatgcagatgaatctacggaccagcaactgaagaaggatgataaaacttagagtataagaaaatacaggttttcactttcttgtcaaattaatctcgagtttaggtcagttatccaatcaaagagctctcatagattactcaactttttggaactggtctatgttctcagattagcaataattagaagcagatcgatttcatagtatggaaatcaggaactgtattatgaatggatcattctcgggctgccaattatgaaccgaagcccaccatctatagatatctaaacatgagcatattcaaatttttatcaaattataatgatttatttcattatccctttcccctggctttgttgtttgcccctaggtacacgatgatgggtagctggctctcaattcatcgtatctctctattgaagggaagtgaacctttaagttctaacaaaaaatattaatgattttgcccaggatcgaactggggacgttatgcgtgttaagcatatgccataaccaactagaccacaaaaccatcgttgcatgcttaaagtgtgatgctaggtaagcatgtctatccactaagtttctacaatgttgacaagcattcaattcagttctttttagttgattgaagatgtaagacgtatagtaagcaaaagtgcataacataattaaattatacgaacaatcttctgttcctaaaaactcaacaattgtaccccactgggcaagagtaacgtaactttaatgtgccagaaacactctagattaaccaattgcaagaattaagtcagggtgttgaaaacacgcttcacagtaaaagtcgtgagctaggtttgtctgtccagatgaatcgttagagtatatgcacttgattgggtaattattcctgccataatgcaccgcaaatacgcggtactagctttattatgtattacataatggtcgtgtcccactcaacatggaattgaattttgttagagaactagctgatcttgaagttcaactactaatccataccgacccctgtacttttctctcgttgttttcattcaaagtctgatcgtagtctcaaaaagttaaagctgatctatgacaagtaattttgaagtgctataaatatggatccaaggagaaagtctacacatgaggagttgctagccgcctcagaggctgtccacaatgaaatgaattctgtagcggcactaaaacgtttgtcaataggaaactcactaacttatgatcctgaccttccatatacagaaaggaatgaatttccgggagaaaaatcgggttatgaagataatacagagaacttcaacgcgtcaatctccagctctgagttaggagtgattaagtataggagagacagtcatcgataccaacgaacttttgtgggtgccagcgcagtaccacccgaacatttcacctgagaaattcaggaaacatattcagagctctgttgaccagatgacggaaaaattgaatcagatatctgagatcaaagctggagttgaaaacccacaatccaccaatctgaacactttcatggatagccgtggagtatccaaggattcaaaccttaatacaagtaaaggtttgaacaggtcaccttcttccaggaggcgatctcgatcaatatccagcttatctgagaatcaagaccaacccacaatcgtgcaactcactcaagagttgcagaagctttcggaaattgcaggcttgaattctacagatgccgcatctttagctcgtagtctgagctcctcgagtctgggctttacatctatagagaaaaatgcatatgggttcacggatgcagatgagaccacaggtggtgaaccttcatttgctatgcaaggtgggtctcagttgaaacgaagcaggtggacaacatatagaaagaatggatcttcaatgagaaagggaaggttttccacagctcaatcgttcaagaaaaataattcactaaaatcgaaaactaatgacatgaatccactagagggtacttcatctagagaagtcacacctagtaaccagcatctactatcagcaaagcaggaagagttagaattattctctaaacgtgaaaaggtgccgaatttatcagttggaagaacaacgagcagtgaacttccacaacatcagcaatcgaatgcatcctatgcacatcttcaacgacaaacacaccaaggtccaagtataacaacccaagaattggatcaagttgactctaaagcagagaaactagagctaaaagactctccagccctgccggcaaaaactacatcatcaaaacctacttcggctgataaaaagaacaaaaagtcgagctggacatcattcaaagataaactgtcgttaagtaatgaatcactttccgatgataatgataagaaggcagacccatctattcacgctaagcataccagaaatagacacggaagcgtcgtaactgccccgctaacacggcaattagacagttcagttgaagagtatgcatatgagccagacaataaagagaatgagttacaagaaaagggaacaatttcaaagttttttggactcaaatctaaatcgaaatcacagttaggtcatagcttcaagaccggaaaagtgaagcacaaaaagaatgagcatgctaactcatcagttattggatcagatagtgacgcaagtatagatttggaggacaaaatcacggaaaaattttccaaagttattctacacaagaaggataggagaaaccagcataggccaagcagcacggatcaagatcctagagaagactctttttataagccatcaccttccggcaaaataccccaaagtcaacagtttgtagaaagatcacaagaagaaaacgaacgattcttgtcacaacaagccagtgaaaacattaaggcgacaatcaaagcgaatgatcaagttacaagaccaaatgggcccatgcaatatacagattcagcgtttggattcccgctaccacctccctctaaatcaacactggtaatgttggactacagatttcctattcatatcgaacgtgcaatttacaggttgtctcatctcaagttggcggacccaagaaggcctttgcggcagcaggttctgttgagtaacttcatgtatgcatacctaaatctggtaaatcacaccttatacctacagcaagtggatgagggtaacacaacaataactggtaagattgaattatagaagaagcgtatggttagattctgttagagagtaaagaaactttttgaataggacggaacctagagcgagcaacacatagtaacccactttccaatctctcgcttcatcacgtccaaatgtcaaccggggaaaccccatcatgttgcaaaatgaatgaacaactattgctgaccatacagatcctgttcgcaagtatagaaagcttgcatatattccaaataacgttgtatatgaccattggaaggcagttgatatggttatggtagttaatgaatatcttttacaatgatacagttcaacagcatgatgaagatgtgctataccgaagtagagtgatgataccattattaaccagtgttggccgaacagaaatttgttggcgtaatcgttagctactagcattaatgaaatggaacatgaccgataaagaagttcctcagtgatgggtcccacaagtagatcacgcataccctcgaggctaacgacatacgccagatcttgcttgattacttctgttgagtttgaatagtaaaaataatctacaataggaccagaaaagagaatcatggtcaaacctaaagctttgaaaatgctgacaatatcatcttggaggttagagaaagaccagctctggttgtgatatcccaccactattccaagtttcgccgtagtttccgcaatttctgacagtctcaacacttttaaaagaataggcaataataatacatgtgtagcagtcaacacactggctcgctggcacctttctttaatcgttagaggattgttacggtctatgggttgatgcggaagggctctggttggtctcaaatggatgactagaacataagacgccgaacagagtatatcataaataataacagctaatctaagctgaatttcagaaaccattagtagaaatgagttgacattgaaccggagtaattaatactactttcgaactgacgacaatatatgatgtttcagaagtaattctccccaattgggtcgctaacacaaccagatgaattattgtattctcgaattcattctacgaaaaaacgtctgatgagggggcattctcttctctttgcaaggttaacaaaaaaaccaatgaaatacagtgaccaattaatagaagagtacaaagaattatggttaacagcgacatctaatgagcttactagagaatggtgccagggaactctccacctgagcaaattatacgtttacttgacacaagacttaaagtattttggggatggatttcgacttttaggcaaaaccatttcgttatgtcgccgtaggcaatcgcttgtgtcattaggcaaacatgtggggatgctcagtaatagtgagaacacgtacttcgtggattgtattaacgatcttactgaacagttattaagagatgggatgtacaatgctgaagaattagaagaaatcagtggtttaacgttacctgccgtggaaaggtaccttttattcatgagatcgatggtagagtcttctacaataacttatgcagaaatgattactgtgatgtttgtaatggaacaagtctatctggattggtcaaataatggactgagaagtaaacctgacaacttgcattggtggttcaatgaatggattgatatacatagtggggagaactttgaaagctggtgccagtttttaaaggatgaggtagaccgctgtatacaggagttgaaggatgctaatagagatgatctcgtggcgagggttgaggagatttttagagaaacattagaacttgaagtcgaattctttaaaagttgttacgatatcacggacgatgaatgatgtatcagtaaaattaattaattaatgaccatatataatatggtataatatggtcttttggagactgactatgtagcttaagccaggcttgaatcctctttttgctcagcgtcgaatccgaactttgatcttttcctaagagattcaccgtagtattcaaaaatccatggaaccggcactaggcctatagcaacaaaggcgaagagagatgtagcccagtcgatcccaagtttatcatacatttgcaccgtaaacagtggaaaagctgctgcaatagtatatctagccaagttgttagctgctaaagcacttgcaagggaaagtggtgggtatgacatgctgaagtaagtaacaaccgtgaagaaaatcaaaatcagggaaaatccaaatggcacacctgccaggaccggaacaatccaatgaattgactctcgagatgtccatgcaagccaaaaaagagatatcggtaaggctaaagctccaaatttaccggataataatctgctttcaggagttggaggtagttggtttccgtctttatctttcataccaacaaagccatcatcgtgtttcttgtagaaacagagagcattcagtactaggtagaagccggttcccaaaaacaagcccacaccgataccaatgaacgtcagtcctgaaattcctagtgacatacgatagactcctctgaaaataacgggataagcctcaaagaaaccaaacaaaatagcgaagacgaaagaaatgtagatggaaaaaacgatgacaataggttcaacaactaacatttgcaaaggcttgacgagagtaatactgagcatgatcatcaaaaatcttagtaagccaacttgtggtttttgcagtttgatttttctggccttggcccttttctttagtaaaactggtgcatatgtttctggcaacatcaagacgaaaggtaacaaagctcctgcaaacattaaattgacccataaagtccatttccagcccttgttttcagcaacaaatcctcctatgattggtcctaacacagggcccataaatggggccaaacaaaatagtgccatggccaatccaacctcgtgagggaggaacacgtcgacaatagagcctgatgccacggcaagacatggcgaagcagacgctccggaaaaaaatctcaacaccaagatagtccagatgttaggagacaatccaacacccattgtaaacagcatagataagggaagggtaacgatataaatcggccttcttccgattaattcggacagaggagccgctattatgggaccaaccgacaaacctagcagatataatgacaaaccagcaaatcccaattcttgtgagattcccatctccatcattaattctgggacaccgcagacgtatagcgacgaacccagactgaccaccaaacacaggaatgcgactgtcattgtggaaaaccatttcttacgtgaactccaatttgtaggattatctggatcatcaggagagtcccagtcaagagtagctggatccacggcatcttcatcctcctctgacaccttcttccggcttgcagaagtgatgaccctggacaattcgtcgtgaaacccttgagtttcggttctcgtcaatcgcagattggttcttgttctggaagcgatttgactaaagtcgttaacgttgccgaaaaaccctttctcctccgaaccatcataatctagttcttcgtcgttacttctagtgggttgcaggggagtatcctctactgtgcgctcacctgactcgatctcttttgtagttgtttcagagtcattggaaggttcgtgatcagtattagatccagtgtcaccattgacagttttgtctccttgtaaagtttccgtaccatcatcatctgggaggttggaatgactgccttccaaggcatcctcaaaatctgttaccgaagcagtccttatagactcttcggcagacacataatcaccggaggtgatcgattgcgactctaacgttctttgagctgacatcacttacacttatgtatgtacgaagcaaaggaagaaaggaggaaataaagaaagaaagctgcttcccatgacagataaatcaacagagaactaaaataaaaaaaaagaaacacttcagccgaggatgcagcaaaagctccgacgacaagaacaataccaaaataggccattgagcgtttaaaattgatgcaaaagaggcacggtagtaaagttaaaaagcgttctccagattgttttcagtcatatcttttattattgtttgagctgctattaaacgtttcaagttcactgtcaaatcaatagtagagctgggggtgctattttggtcggggtgcagaagttaatttttcaatagaggtgcaggcggtttctggaatttgttgcgcgggctgcctttaatgtttagaattgctcgagccttctctttgttccttgaacaaaggtgcagcatgcaaaaaaggcttacataatcatgctcttggtgaattaattggggagagcttacgtgattcatagttgaagtgcacttattctaatgggaaatgatggcggatccataccaaagagaagggagcttctccgaataaatgagtcagaagctcaggtcaatcgttccaagttgtccgttaaattggactcgtggtattattgttcgatttcagaggagccactgaggtatagtgagggtacgattgtctcggactacagaggtcgcctatacaacaaagaatcagtactaaaacaccttatatccaagaataaggatctacctcatttgaaatcgctgaaagatttagtggaattaaggttctgtttcaaggatggcaagatttcatgtcctattaataaagacatcatcttggatttggacggaaagaatgatatacccgcttttgtgtatttagttccctgtggatgtgttgtttcaggaaagattgcaaaagagattacaaaattgaagagcaagccaatactttgcccagtttgtaatcaacctttcgaacatactaacgtgattcctatcaaccctagcaacacaacagatttggaatccaggatggcccggctacgacgggaaggactgagtcataatttgtccaggcgtcacaagaaatctcgtcctcatgaagggtccggcgagcctgatacccccaagaaaagagttatgaaggcagaaaaagatgcgaagctgatatgcctaagctaagtaaagttatagcaaaacagataaaataacaataaaaattaactatatacattattggcttgtagagggcaggtctaattggtgactggttgctcttcaatatttgcttgggctttagcagcttccatttccttctggatagctaaccttcgctcgttttgttttcccgtttggtatatggtccaaccaacatttccagccatgtaaaaagtgaatcctactaaaccaactattgtcagtctgtgagctatatctgtagccctcgtgtaccatgggtaagctttagacattttaaaaaggtctgaatatcggttaggtaatttggaaatcagatggaacagattttagtcttcagataaaggttggtacactacaaagtgaagtacttagttcgttaatgggctattcttggattgagattttgaaagtttgtgttcaattgctaacgactcgtcagcagatggaatgtaaaactcttcatatctgcttagaatcaagactacagtagttttgtttttagattggcttctcgtagaaacgagtttttctttaggtttcgaaggtgaaatcctagttacatctaaacggtctttcaaagcccgtggttactcaaaaacaagcataagggaaggtattcaagaccaaaaatgcaggacttagcgttgctgaaccagtctttcaactgccccgtttactataagcaaagtgaggcaagttaagacgtcaatcaacaaattcctttgaaacttcctatatcactttccttcacttcgtcgtggctccaagaggttaaagttcacaggccatagctccgaatcgatctagaacatatcgtaagatcattaccatcgctctattaggggtagagtactacaagtatgttcaatgcgactccaatatatattaggcctctgctaacgagggttcaactgagtaaaacattcaacgaaagccgttaacaaagccagtatttgctagtaggggtttgaaagttaaagcattgaatagattaattagatagttgggtgccatagattccagctaattgcaccacctggcaggatctatcccgttaaacgaggtgttcctctctgctaaaattgcgaaaattgctaaagaaaacaccctgcatcaagggggttgaatgtcggttaattagacttggatgcacctccactttacataacttactaatctgaaattaatccttctttattctgctttataattcgatgaatggatatgtgctagtcacaggtggagcgggctacattggatcccatactgtcgttgagttgctaaacaatgactaccttgtgatagtgattgataatttgtcaaactcttcttatcatgttataaagagaatcgaaactctgactggcaaatcagtgaccttctttaatatcgaccttagagaagagagtaagctcagaaaagtgttccaagactacaccattgattcagtattacactttgctgcattgaaagcggttggagaatctgcaaagtcgccacttcagtattacgataacaatgtctcgggaacaatttctcttttgaacgtgatgaagcaaaataatgtgaaaaagcttgtgtattcgtccagcgctacagtgtatggtgatgccactagatatgaggacatgattccaattcctgaaatttgccctgttgtgcccaccaatccatatggaatgtccaaggttattgtggagaacattatacgggacatattcgcatcagacaatggttggaaatcggctatcctcagatatttcaacccaattggagcacatccttctggtttgattggggaggatccttttggtactccaaacaatttacttccctatttggcacaggttgctatcggaagaagggacaaactatttgtttttgggaatgattacacttcaaaggacggtacaccgatcagagattaccttcacattgtcgacctggcccaaggacatattgccgctctcaaatacttaggtacccgacaggagggcatatgcagagaatggaacttgggaacagggaatgggtccactgttcttgaagtttatgaggccttttgcagcgctgtaggtagaaagctgccctacgaaattgttggaagacgagagggtgatgtgttgaatctaacagcgttgcccacgagggccaatgaagagttgggttggaggactaaactcacgattgaagatgcttgcatagatctttggaattggactacgaacaaccccaacggttacaggatagaagagcaaaaatctgactggttggggaaaaaagattccttctctaaaaaactatgtcgagcaggaggagttaacacctctgaagggcctattttgccagcccgaatattggatgaatttatggagatagaagtgaaaacaacgaattaatgttattcttgaagatgtcaagatacaaaaatactttatttagattagaagaaaaagtgcttgaagcatgctaaaataattcgaagctagtccatttctacattaactgaatgtaattgttgtcttgagatgctacaagtaatatagttaaaagtgacttgatgttgcttttgctttaaatcttctcatggcacctttatttgactgagtcaagttacaggcttgagggcggttgaccagatcatcttcgcaactagaagtgggatccgtcaattactagaaaattccagttggtgaagattcaccaaccagccaacgatcttgaaaactcttttaaaaaagagccttaccaggcaagaagttgctatgcttaatggttatactataaagtaactaactatagctagcatcaatgatctacgcagtaaaacatctctacaccatactacaccaccatgacgaattgatcaattttacgccatacgtgcaatacacgacgaatgcctaatccagcactctgaggcttgctctcgctagtatgatgacattacttcaattgctagttctggtatacataatatataaagtgtttccgatactcagaagatttttcagtactggaacaatggtgtccgaacaggttttaagcaagactaaagcattgatcaaagatcacaaggtatttgttgcatccaagagttattgcccctactgctcccagactaagaagttgttggagtctctaaacgccaatgcttttgtagtggaactagatactgaaccagatgggtctgatattcaagccgctcttttagagctaaccggccagagaactgtacctaacgtgttcatcaacggagagcatgttggtggaaacagcgatttgcaagcactgaacagtgaaggaaagttaaaaactcttctcaagaactaaagcctacttcaaaacgctattatggcctcaaagattaatcttcggctctactgattagagaaggatagatttgttctgcgtccgtcgtcttagtatatttctctgatatcgcaactcataatacgtgatttggatagctaagtagtttccatttttgtttcatgtatacacaaagtgtaattctagatattttgtagcatttcatctgtagcaaattccaatgttcctgtgctgattccattcaattgccagtagttaatgatgcgattgatcggagacatcactaaggagcgtttttccctcagaacctcacccttcattttgttttccttagtaaactatcgtcttgcagtaaatccacccctctggttgtatcttcttgttttcttcacaatgggagttttttctgagcatccttacacttcaatcaccacaacgctggatcaaatcaccgctttacctaaggatcaaagtgacgatgtgatagagtcaaccattgctgaactaatcaattcaattcttatctccaccacaggacagtacgaagcagccaggataattcgcaagaaactcaagtacggctcgttaaaccaacacataaacgctttaaaggtgcttgatcttatcgtaggaaatggaggtcccagcttgagccagttttatcacgaccagaagcttattgacaggctgcgtatcgatactcgcagcaccgaaaagcaagttcaacggttggctattcgcctgattgttggttggaaagaacacttcgaaggtgaaaaggcctatgcgcccttggtacaattgttttactcctgtaaactgtccaaatcgaagagagctgtgccagatttcatgaacgatcaggtggaccaaactccatttgaagaatactatgaagatgaagatgtccagtcaatgatcactaccgagtcactcgcggacgagcacatcaaaacctatcagaccaacaaagagcttgacagaaagtttaaaatccctaagattaactacattgctgagaaaccaagaattcaaaagttgatagcagaagcaatgtccagtgccacaatcttgaaaaattctttagagactttgaaagatggggaactttcagtagacaacgacaaatgtgtcattgaatttggcaaatgtagacagattagaaggaaggttctaaggtacttacaactggtcgatttggaggaccttgttggaccattaatccatgccaacgaagaattagttgcagcactttcaaaatacgaagaaaaggcaactgattcagactctctcgatgagtatgaagattatgatgagggcgaagatgtcgacgagagtaatgatgatctcagtgagcaaacagaaatcgaagactctctgtccaagctagacatttctcataagaaggcccctcctccaattccttccaagaactccgctccagagcccaataacccattcagcgatccattcagtgacggtcatggcgtcggcggcatcgttcacgacgctcatcttccgtggaagaaataagagagagtttgtgcataagagataggtactagaacttttttgtagcctgagctctaacgattaaggatttaaagttcgcgaagcctatcgtgatatttcactcactatatagcaagattggttgcaccactatcgcaatcttgacctattttctttcgaaacttccttaattgttaactgctataatgcccgccattgttgatccttcgtttcaaacgaaccatgtttgcctgcatgtgagtgatattcaaaagtctatcaagttctacaccgaatattttgggttgtctttgttggcccaggaatcggtgccccaactcaagaagcaaatatacttactaggttacaattcgccttcaaatgccaattatggaaagcactgggctgacaggagcggtgtgcttgagctatgtgttgatcaaactcttccaaaggactacaagtttgcgaatggaaattcacctgaagctcaaggtttcggacacatttgtgtagctgtggataatcttgagaccgcttgcgagcagttggagaagaatggcgttgctttcaagaaaagacctagcgaaggccgtcaaaaggatattgcgttcgctttggatcctgacaactactggattgaactaattgaacatcaaattggcaaaaaagacggtgtctctaataagagcaattgggttctgaaccatggtatgtacagaatccgggatcctaaggtatcactaaaattttacaaagaagttttaggtatgaaactttattctactagagaatttccggaagctaagttcaccctctattttctgggctacgagcatgacgatcaatacgtggaaaaccaggaaaaacctcgtccacaagctgagagggaatctattattgagttgacccataactggggtacagaaagtgactccagcttcaaaggttaccataccaacaccactgagccttttggatatggccatacaggcattaaaacaaaggatgtcgccaaacttgccaaagagcttgagaatgatgtagaatgggtctttaaattgggagagattagcgacaagcttgccttcttcaaggaccctgatgggtatcttctagaaattctccagaatgatagttttcttaaagaccaaggaaacaaattataaaaggcgtcaataaacaaaatttttactttatttatttagtcattccccccgcttagttctcttcttcaccttgaaattttaggctgatgctgttgacacaatgtctggaatctgttggagtgtcaaatccctcaccctcaaaaacatggccaagatgtccatcacatttggagcatctgatttctattcttcgcattccaagcgaattgtcttctattcgtttaactgctccaggtaatgcttcatagaatgcaggccaaccacaagatgaatcaaattttgtgccacttttgtaaagcggagtttgacacccactacacaagtaggttccatttttcttgaagttcacatactgtccggtatacggtctttctgttccgcccaaacggaggacttggtattgagcgggagtcaatatcgctttccagttagtcatggtgataataattgctgttgaatcattgctaaattggttttagcaagtgggcaactagaacgtattgcgcgaagtgatgctaatccatatggtttgttggactatacaaaagaataaaacctagttacagtaaatatagaaaccccggacattcttaaagctcgtcgtgagcgtctgcctcactttcagcttcttcttcagcttccttttcttcctcgactggtctgagtgctagggcatccactttgtgggttcctctctcctttacaaactcagccaatgattctaggtcacgagatccatcatacagttgaggattggatttatcaccagctggataaaggatcaaagtaggataaccttgaatatcaacgttgtcgacatcgttcaaagtgtgatcaagttttgcaatcacaacctttgaagaggcatcctcatcattggcgtaaagagtagccaattcctcataagcaggagccattctcttacagtgaccacaccaaggggcgtagtacttgactagaacatctttagattcatcgaagacaacttcatcgtgggcctttccgactagcttgaagactttctcttcttgaatttctggaattggctctgatttcacaattggttctgcctctcctgcgatgaatttctcaatcagctcggtcacatctttgttcgtcaattcttggtcttgaggaactccaaacttcttgttgctcaccaaatcatgaatgacaaatagagggagtttctcttcatccatgtttaagttcttggcatgcttaccgaatttaacggcatctaagccaacaaagttaattttgccacgttgctctttagcaaaaggtttaataatatcggcagcagcagcacgttgttcttcgttctcatagaaatagtaggctaaagggatgttagcttcagcatatgatttgaaggtggatccgtcaatgtctccaaatagaggtttggactcaatatcaatccagtgcaccaaatgagtctcatctaactcctcaccagagtaaacactaggttcctcgccaggtctgacaagcaaataggcaggagtcgagtcgctagtgtattttttggcataatcagtagacttagtggagacaaaagtgaatttctctctgagagtaccggcaactccgtaaaatgtggtgttagattccaagttggatgcatcttccggtagtacttgcacaatcacgggctcttttgcctcggcgattgtgtcgtctaaatctttggttgcattgatttcactgacagggggtaaactctgctttagcatatagctgacaatgctttggctctgtctttgaccttgatagtcacttgggacctcaacctcaccatggaacaccttcaaagtaggataccctttaatttcgtagccttgacataattccttctcctccgtacaatcaatttgagcaatcttaacctgctcattgtcctttaagatctcggcagcagaaacaagttcagggcccaacttcttacagtgaccacaccaaggggcaaaaaactctgccaaaacgtgaggattactggtgatgaaagactcaaaagtggcttcagtcaatttgacgacatgagagtcctctggagcaatagcctcctgatcacttgcttgtgctagtgtgagagcggacaaaatacttgccacagttttaatattccagttgaattgcattcttatagataggaagaagaagaaggtttggaaatcagtacgtgttcaattattgaagttttaggggtgatcgcgacgtggtgctgggatggagggcgtaggtatgtctggtagattatctttgagtgggttgagaaagatggacgattccattctggggattgcaatctaaagagccgcgtaagacaatagaaacactacattgaagttctactatccaagttttcttttattctatttacagtgttcgtgttctattcaacagggagtgttcggggtcttctcttcagccactccttcttacgtaaagttcgttcatcgggcagttctttctttcctggataaagaatcttctcatccaaaggattaacaaactcttcacgaaatgcctcctgttgaggaacagagtcgttccaatgtctcctgatttgtcctacgcaatgcatgcagagggtgtgtgatcgtttgtagtttccgcaggcaggacacctgttcaaattttgtagtaaagagagttgtttttttcctggaccatataatttctggcgtcttttcatatgagaaaccttcttttttggtgctgctttaagtataccgttatcaatgaagaatggaggaacctcggcatcctgtagattttctatcagctctagtatgcgaggatcgtgagtctctgtagaagcttcggtgcgtcgctgaaaaatattaggaatggcaatgtgaatctccggaatacgaggcaatatgcccacaacccgcacggctatctgatttaggttcaaagacaaggacatgtagacacaaggttgatggtgatccaagagaaatttgatgtcgaaaatcttcagtgagaaagtggtgtaaggtggtgcttagtttatgatagctagtatgcgaacgtaatcaattgaatttatcaacagcccaataaatcgaacaaacaatgtttcttaacgctactgtgggcgcaaagtaaacaatagccgaatatgtctccctttaccaaagcagctttagtagaaattgaagagggaaaaactaagaacaccactctcgtaatagagctgcacggaaagatacagtcgcgaatgcaatcgcctttctcctcgatttctgtgtcctacctgtccacgcgttggttacagttattctctttcattttgttcgtcagataatacaaaaactatggcaagtcaagtggttcaacctaagaattatgtggggtttgatactatcactacccaaattgaaaacagactccttaaacgtggatttgagctcaatgttatgcttgttggtcaatctgggcttgggaagtcaactctagtcaatactctttttgccacacatcttgtggactctaacggaagaaaaagtacttttgagcctgtggaaagaactgtagagattaaaagcacctcccaaattctcaatgaaaacaacgttaatctgaaactcaacgtgattgacacacctggttttggagatcagatcaacaatgacaaatgttgggaaccaatattgcagtatatcaaagagcaaaactctacctacttgcgaaaagagttgacagcacagagagaaaggtatatacctgacacaagggttcattgtgtgctttacttcattcaacctaacggtaagggactgagaaaccttgacatacaagttctttccaaactcactactgttgtgaacgttattcctgttattgctaaggctgacaccttgactaccgaagagcgtaccaagtttaaaagtattttgcacactcaatttgagaaacacgacctaaacttttttccgtacgacaatgaagatttgagtgaagaagaactgactttgaatcaagatatccgaagtcttttaccgtttgcagtaattggctctgaaaatgagatctccacaattgatggacaggtcatcagaggtcgtagaacccgatggggtctaatcaacgtggaagatgtaacgcagtgcgaatttgtgtacctgcgggactttctaacacgtacccacctccatgatttaatagagactacttcggtcgttcattacgagacttaccggtccaagcagttaatcgcacttaaagagaagaatgggcaacgtgtatcaaacgctaccatgcagtagaaaattcgactaagtaccagctaaatacgaaaatgatgctatcttataccttatatttagttaaagttttacctgtaatcatggaaaactcgtgtcggcttttcattgtaagcttcccagggaaaaacatgaggtgctggaggttcaggctgaacaatatccggtagcagctcctccaattcagcttcggccttcgtctcttcgcgttcgtcttcttcaacagggacaggcagcggctcagctggtgcatcaacatcccactgattagtcaattgttcttcattaagcttccatgcttctccctcagttgaataatctaataccggtgcaggttcttcaaaggaatgatggccaaactggtacttgaaatcagtggtttcatcctgaggctctgaaatggagacttcttcgtccaccttttcttccgtctcatgggagtcttcttcaatacgttcgctttcaacattcttaaaaaccaaaggtagaaactcaccgttctcaaaagagctaaactgctcccaccattgggcaacaaaactgtcaagactgccatctggaaagtcgttcacaaaagatggtttaagcatccatggtttcacaattcctatgaaatgaaccaatttgatgtctgtgagatttcgcagtactgaaggaagactctcatagttgttggaaagtgtcatattgaacgcaaaactaagattgtaccatacaccacaccgttttgtgtcatcaccagtgcgcaaccatttgttttggaatacatagttaatcagcccttgatcccctccatcataggaaacaccaggaacttcagttaaaagagccaacaaatgcctgaaaacattagcgctaggtttgaacaacattagaccagaattaaagtaatcaggccagcctatatctgacacagcatacaactcccattccttaacttctatgtcaaacagtcctttaaaatcatttaaaattaacacatccaagtccacatacaacaacttctcgtaatgagtctgatggaagatatgaatcttattaaggacattctctagatctggtctattcagcaaatgtagctcaggagcattgtaaggactggttgcaatcttgctatcaggaagtaacacaaccacttttgagtaaaatcgttcaagtagtcgatgcactttgatactaatatcactaactaagataaccaaatctctctcattatcaaactgacgaatacgatttgccaaatacaatgccccaggcaagtatccatctcctattagaaggcttatgtaggcttctgtcatcgcaattgaggagagtgtggagtaacattatgtagtaatgttttgattaacgctgagcagtcggatgtaaggatgttggccggaatgtcgatgagtgtggcctgttttcttcctttctttttacgcgtgcagagttgtttgagctgcaactatgctgcgagcatgcgctatgtaccttgttttgaactttgtctggtcgtttagataattttgtgggtcaaagtcaaacttcgacacgaagaggcaacacagccgaaattgcgtcgaatcgcagcaaattgtagtaaagcggaggtccttttatatgtacacagtgctcaagatgaaatctatactaattgagataattcatttagggtttgattttgtacacgaaaatgctcttgttggattcgtaacaagtgctaaaaatgttcctcaaatatgttctattctatgatcgtgctgccctgaactccctcttaaagacatttttctcgtatccccgattcgaaagtttccgaatcaaggttattattgaaaaaaaaaccagtagacacaatgcttggggaaatatcgtcaccaacatcatacgtgctctagatttgattcctattcaggtttctgcacgtttggattctgggccaatcctggttcaactccacagctgaatagagagaaaacatcttttgtgggatcggcggcatgaaccaaacaacaagaacgttgcatctatctgtttgttttgaatgtttgtcacccttatcatagggcaaacagatgcatgcataacttctaatacgtcgtgtgccaaaccagatgtggacagctatgcagaacaaacaataaagtctaagtgagtaattatcaaactacaaatactacgttaaatccgagccacaacacaaagacaaccatatacttgaaagcggctacagaaaacgactgattcgtacaattgattatgacaacttatattgttctaaatgtagagtcaaaaaaagttcaggtagagagtaatgccgacctacgcgtatgataacgcataatccacatgtgcatatgcatatccttaaaaaatcactcagctgtggtccatattcgaactgttttatcatcacctgctgaggcaaagctgccattacaccagtcaacacagttgaccaacccctgatgcccagcaagagctgtcactaaattcccaagctgtgaattccagacgtacactcgcccatcttctgacccacttaaaaccagttgatcatgtaagcccccaaagcaggatcgaataacgtaattcggttgctgctggccataaaacttattcactagtacaaggcgtcgcatatcccaaagctgtaactcatcaggagaaatgctcaaaagaaagtgagacccatcttttgatactgtaatagatgttaaccgctttcctatccggatagtatgttccaatcgcctactagcaacgtcatatatatgcacatgatgatcatgggatatagtcaagacccgagcaggatcacgagctatgcaaagatcgctgactcggtgttgggcctgccaactatacacagttttaaagtcctgatccaaaattataagctttttgtctggggatcctatgacaaactggtaattatctatccattcacatgtccatactttagtacgattaggaaattccatcgaattgataagttcaccatcatttgcattatagattcgaatatggcaatccagactacaagtgaggatcttagtatcgttagggctccaggaggcatacataatggctttggttgcgcctttcaaaatagtgcacactttgtagggtgccccaaccttgtatactagaaccgtttggtcggaagatgtcgaacaaagatagtggcccgaatgactgaaacgaacaaaccagacttcatccttatgatcatcaagaacgtagctgcactgataatgtagcttgtggttacagtaatcttgtaggatcgggtatgcgttaatggttggcttctttcccaccttttcatctgtattggtgccatccgcaccttcaattacactgacttcacccaaaggcgccactgcttgttggtgcaattctgcttgtttgataagctgtacaagtcttccaggaggaaacagtctgccaggatccaccatccgggatacctcttgtataatttcatcaatagaaggccatctaacatcaagagtggacgccgcatcttgtgaggcttccttttgtaagaccaatgccatatctctgagttcaccttcgatccaacctaatttgttctgcaacgggctgatctcagtacgtaataaattaagagcctcgtccctttgtccattatcaattaaactgaaaaagtaacattttttcaaaagaaaagagacctttaaaaaatcacttggatctagctttaagcaacctgccgccttctctgcggcgcaaaattcgtgttcggccagtagcgcgaggaagtcatccacttctatgtcattcagagggatggaactctcttgttgtaacctcttgcttaatgagtcatatccaagatcctttagactctgctcaaggagacgaaccacttgcgtacggtctaaccctttcaatgagtccattaggataattctatgagtcgattcgtgggtggtacggtacggcaaacgaagcaaactaacagagtatgacatcgccagataataaatcatgcgtacacgactattctgcttaggtttttacacgactttttgtcttcatatatcttttaggacagtcagtagtgggactaaaatttggtattagaaacaggaaggtatggatgttggtgtagatcaaatatcccagctgctacctgacgttccactttcccgtatatatacagtcttagaagaaagaaatggcgatgttcagtcagcactggagtacctgttggaaccaacatcggatggaagaaataagagtatttcgaattcttccattaaatcaccccgcacacctatccataccaatgagaaagctattttgcagctttacgagatgtttgagcatgtaccactaagtgttctacagatggtgtaccataatcatcgtgaacttgagagcgcactggagtatttggtacactgtaatactgaagacattgaacgactgaagattgttgctgaagctgaagctacgatgaagcaacatcctctttggcaatttgtgcggacagtcctaacaactacaaatgtgtgggagaagcggactgagacagtaaactttttggtcgaactcctaggcagttcccagaaacaggtttcacaggtggttgccaaggaacatggaagtgtggatctgagtcttcggcaattgctgctagcaggaggttcttcctcctctgagtccacctactccaatactctggcaatagtggaactttatcgccagtttcattcagagctgtatttgattgacgacactatgttgaggctcttgttgcaacgacttgcgcctgaacttgtcaagatactaattgcacttcacgctatcgttaaggagatggaccagattgatacgtctgcgagtacagagttttcaactgccccactttcaagttttaatatggggcaaatggttgccactgacgagagaaatgcagcttcatcgttgcattacgctaaagctgcacatcagagttccggggcaactgatgcgaatgcgactacgagactgctgaatcaaaacagcgagaggatcaccttacagaaacattgtgcggcgctggcggggcgggtttccaccgccaaggattctcgtgttcgtgaccactacaattcagaatatagacacgccaagaagcaattgcgcttgcatagagaacagctgcaacaacagttggtggcacagaggacgcaggtagtaagtcagactctagaccttcatggtttaactgtaccaatggccagggatgcaaccatgactgcgctcagccgatggtggagcgaggagataaagcttcgcgaatgggatggcgtgcgctacaaacacacgggaccagttcaacatatggaacctttgcggcttattactggccgtggcatgcacagtactggaggcttcagccagataagaaagtgcctcataaaagaactagaaggctcctggatcctcaatcgagacaatccaggagaacttatggttctagggcggaggaaaaatggtgtggcgagtaaataatatttttgatttatttacgcttacctgcattcggaagtggactgccgagattttctagcatctacagcaacagatcgttgatatcattaattgattctacatgcacgcttttgattaagagaaactactttaatagtcatgatgcaaaaatgaggagagatgttccgtaaaattttctcgattaattaacactcttttatcagcccagtatccaagacgtaaacgaagatgtgatactgagcctctcagtaagtctggaacgtcctccttggaaattccgtagttgttgtaaataaggtcgtgtaaaaacagacgcggttcgttgtaaaaaagaatctcactgtcgtcgctagcgcaactgttcgaatcttgcgtgtcttcatgtagcattacatgtatcttcatatttgccttgtatcgtggaaagcatgcatgttctttgagccattccatattctttaagttactgtggaaattaggcttatcgataatctccagcttgactagcttgccattgtaatcccggatggttttcacaaatttgtatttttcagattgtacaatcttgtccatatattgcagaaatgacatgctgttatttttgcagtcatacttcaaagccctgaagttggtgttagcaaccacatgtgaatcaaacaggctcgacgaacaacccagtagcctggatatgctttctagtagctggtcttgctccgtgggtgccggtgaagatggtgatttacatactgcaggaatatttctcatatcgtattcatgaatgtcgtagagcgatttatgaagcgatgaaagaatggattgaagatcactgtagaccatgagccgagcattgatcaacagagagtatggacgtcctctcttgccgttctgagaactaatcttattgctaaattttgtgtttgctgtgtgtttagagagctggtgacatttgcgggccaaaactagcttggaaaagtatggaagactcacttcaaatgaatatctatactgggaagacgggtcgagctgctctgctccttctggatccgtattactttccttttcgccttccatgccatcaggagagcctcccggttccccttcggtgcttacactttctgtgcctgtgtctatactgttgcttgcagaagaggaacctgacataggcacgatgcaattaggagtatcataattcaagatatcctgaatagcgatccgtgggaacaccattatcttctggaaagataccgtggtcatgggttgacatttcaaaaaaattgagaataagtctctttttatattaaggagagaagaaatccggatgcagcatttgtgttgtcgtgagaagcatcattaattaggccgaaaatttcactgttgttcctcgcagctgcatgatgcattaacgaattattgtggcagtagcatggatgtataccagaaattagatgatgtgcaaaaactaaaaaaccggaattagggtcattttttaacccttctgcatggaacaagggtttttccaaataatggagggttcacttacggtaatcaaagcactacaggaacattcgaatccaataggacgcttcgaaggctagcgtccgtatggaccagaaaacttacgtctttcttattgcatttctatcaaccccctgacatatacgtatttggcatgttcctcgctatttgtaatatctgttttctgcacagacacaacaaacctaccgttgaattactgcactgtaaagttttttttcacaaattgttcgtcgtttggtgtagttattatgagagacgcttagagccctaaataggctgcgagttgctctcgtttgttgaaactctaaaagtgactttgccaatctcgtttggtggagtccacatgatgatcagagagccctcggttttttttttatttctgaaacagtaatgctgtacgtgttaagatgaaacacccggaatacacacctgatgcagagaagttcttgaatgaaaaacctttatgagtaacgctcaacttgcggttgaatcggctgatctcattaatcccattaacccactttggtcgaaccttgggagatcagaaaggctatcatagactggacactttacacaacctgctctctattcctggttggacaagtcttaggaaaagatcggctgcagggctggtaagtatgcggtgcgatgctcagataattagtaacagtttttctccatcttgtcttattacattccacaagaataaaacgagctaagagcttcctgcataatcttttccttacgacatgcggaagttttccaaattatacactgcagacggaaagaagatcaggcgatgtaaattcgattgagaactttttctctcagaagacggattgcgacaacatctttcgcgcattctgtatctctagcgaatattggctttcacctcagtttcgactctattttcagaataatccccgatggcctcttcaatccattttttagatattaagggcaaacccttgctcaccaaagactacaagggggacatacctgtaactgcactggaacggttccctcttttagtacttcaaggctcttcggatgagtataacactaaacctgttttccaggatagaggtgtcagttatgcctacttgatccacaatgatttgtacgtattggcacttgctcggggcaatgtcaatatatattcgataatggtttttttgaggcgtctaatagaggttcttgaaagttacgtcaagcggttggtcgaggagagtatacgagacaatttcagcattatttacgagttgctggacgagatggttgactttggaacgccacaaatttctgatgttcaaatgctcaaacagtatatcaaagtgaaacatttcaagctggaggaattgatcaaccctatcaaggcactagacaacgatcaaaaagtcaaagtccccatggccctgaccaacagtatcagctggagaagtgaaggaatttcctataaaaaaaatgaggcattcctggatgtggtagaagccatcaatatgacactgacgaccactggtcaagtgattaccagcgagatattgggaaagatcaagatacggtcacaattatctggaatgcctgacctgagattaggcatcaacgaaaagtttttgaatgctgggttagaccgtcttaatggcggtcctgacaacgtaactaatgactttgggttggaggatataaaatttcatcaatgtgtccggttagcaaaatttgaaaatgataagattataacgtttattccacctgatggggagtttgagctcatgacctaccgcattctgtctcctcccaatcttgtaccactaatacttgtggattataagctacagaatcattcgaacacaagactggaattgttcgtgcgtctgaaaactaacttcaaacgtcgcctcacatgcactaatttggaattgctaattccttgtcccgatgacattgattccccctcatttcaaacctcggccactacttcaaagtgtaagatcaaatatgtgcctgaaaagtctgctattctctggcgatttaaatctattccagggggtaaagattattcgatgatagctgagttaaaccttccttcagtcaagcttcaggagaatgttgaccagcttaagaaaattacaaaaaaacctataaaagtcaactttcagattccctattttacaacatcagggcttcaggtccgctatcttcgtatcaatgagccgaaacttcaatataagtcgtacccctgggtacgttacgtaacacagagtggtgatgactacataatcaggatgaagtaactcaattgcaagaaaaacacgattaacgttttcagttttccctttgaagaaacaactgtgtcaaaatttgtcgtaggcaataagatatctggaaagaagaagagtttattgcggtgataccgtcttctatttatcagctaagattacacaaatgaatcattcaacgagagttcttccatctgcgagcgagctctttgattgcgtcagtggcactgcctgtctgtagataagcatcttcaaagccttctttgacaaactgggcatacttggaagcgggtcttttgggatattttttgtaaaatgcctctttggctgtttcatactcttttaaattggcgtcatactgggctttgtacttactcttggtagcatcatcgattgatcgccattcctcggagaactttttgctgaggccaacaagatcaagcttttcactagaattactcttggcagcagcaaatcggtctttcaaaaatagggcgtaactagtaactggaagtttgggtttttccaatctcttttgttgaagcaagctaaggggtttctctttcgtttgttttgttttctttgcggacgccgatgccttagctgattgtgcaattcccttctttcctgaagcaacggcatatatgggagaaagtgtcgtgaatagccgggtacgtgaaatactgccaacgaacgttgttctggataattgagtgattgcttgcattgtttatactgagagaaatggcaagctggttcaaaaaaacaacaaaagataactatcgcgaaccaggttaatggtggagagcagaaggatcaaccagccacttctagttcgagcagaaaatataacctcaagtgtcccaagcaagtgctggtattcttatctaccggagccgcatgaatgttatggaacaggaaactttcaacaaaatccaaacagtttatctgagccataagaaagggtataccccagaattgaaagcgaagtttcaagaattaaaaaacccaaagaatttagctgcatgcacgtcgctttcaaatttggtacaccatattcaattgcatcaagatacgatagtcaaggtggttgatttggtactagaaaatagacccatacctgagttttttgacttgtgtagtagcaaagtaaatgctgagcgctttcttcggaagaacatcctgctaaatggcgtaaaacgagaccgtttgcggaagctcttaaagaagcaaaaagagtttgaaaaactgtgctaccgggatagaactctctaccattctgacttaaggacgaagttggagagcgatgaaaagcaaatctacttcaagctacgtaaatttgatattgaaatccacaagagacagtgtaagttttcgcaagaaattgaagttgagttatcacgattacaagtaccctttttcgttgaacagaatgacacttcacaggaagattcaacttctggaaagagctatattcttgacctcatagtagaccacatagagggagaggggataagctcaagtgacacgagccaaaacactacttaggcggtaataacacaaaatggtctggaagtagagaccacgagataacaaatttccacgatttagtcgatgtatgtgttgctggaaacattgaattagtgacgctaacaatctcaatgcactttttacacagataaattattcggtttaatatacgatgagtaaagtgccttctcgttgcattcattactcaaagagacaaagatgtgcgcacaatatcgtagtcattgcgaatgatatcatttcttatccttattctcaacaccgtcatcgtaagaagtgaaatcatgtaacttacaaacgacaacaaaagagcttcattttcatcgtgtaccagccaatgctattgggtaagaaattcactaaatcctctttgttcttagagacaaccaacctgctttcaggcaaaagagacaattgtcaagtgtgcaactgttgaaagacaataaggttcaccgtggttttttttctaatatgcccctctagctgaagatttaaccgagaggaatttctcctacatggaactaagcgcagcgtcaaatgagatagagatggcatagttgaggcatgacctttctcaaaatcatgaagtcagaattgagttgggatggtcagcttctgctaagaccatgcaaagctgtcatcacctaaatctccatgttgttcaagctagaggtatagatcattgaagatgttgtattgggttgattaagtaagcgttagttttttgacacacgcaagcttaccagccgggtaatccggcacaagttttcaaaaaaaaaaaaaattgaacatcgttggacagatataaggtcaacacgagtaaacacgagttaacatcagtcagcacgaccagggaaagatggcgtcattccaacagaaaacagacccagtcaatataggtaatagctccagctccggccccaacatacaccgtcgatcctcagtatctactgccccatattctatccctgcaaagacgagccataattcggaaacatatcaacgaaaagggggacctgttcatactcaccaccatcatcaccatcactctcatggaaactctcaaggacagcatttacacagcaacaacagtaacaacagtagcggccaactttcgtcttcggttccgttactctcccgagagtttgtcgtgcgtagaatatccgaaggtgaaacagggcgacttaaggaagagctaaagtgtgaagcctgcggaaagggttataagcacatttcctctctagctaaacacttgtgggagcatactcctgagtggaatgtcaccaagaaattgctaatttccaaacatcagcaagtacaactattagaggctgccagtattctgtgcagtatgacagacaaagaagaaaaagaaaaggaaaaagaaaaagaaagggaacgagaattacctggattcaaagccagctacttggaatctgggtttccatctatcacttcaccgccctcatctctgccatcatccgttcccagcaaactgcgtacaaactccatttcacagtacccaccttcaagttcagcctataaagaaaatatgcccaagccagtgactcaaggaggttacctagatacaaatagacaaaaaatcaaagaggaaaaggtgaacgaagaggaccctatatctaaccgcgccgatgatttacacaccggtactcctcggtttgtatctaaggatccatcttcgtcgccggtcgatgaaaatgataacgatgatagtatctttggagcaatggagtgagattggatgatgcatgagaccgaatataatctaaattctcagtttaaacaacggatataacatttcagattatgttacaggaaaaagtcttctccattaacgaataaaaggatttgtatatattccatagattaatcctagttatcatcatatattcatcatactagatatctttggaaagaaatcagagatccttcgcgaagcttttgtttgaatattactcacgtataaagctcagaaatacaaataaacaaacttcccccctcaagtcgcgtctccaatggtcattcctgaaagcagatccgagcttttgagttggctcaatgctactttagatcttaattacaccaaaatcgaacaatgtggcacgggagcggcgtattgccaggttattgattctatctaccatgatcttccaatggctaaagtcaactttcaaggaagttcagaatatgattacatgaagaattataagattctacaggccggtttcactcggcacaaaataacacgtaacattcctgtcgaccgtttggtcaaatgtcgatttcaggacaatttggaattcttgcagtggatcaagaaatactggatggagaacaaagatgaaaccgaatatgatccaattgctggtcgctcctctagtatgaatagaggactatcaacggccacccccactacgaaaacggtcggtagaacctctgtttcgacgaccaagaagattgaaccacgaaatgcattaccctcaacagaccctaatagaaagaaatcctcaaatttacataacccaagattaagaggaactaattcaagttcaacatccggtatcaataaagaagtgtatgaccttaagtctcaagtcgcctcactatcagaggagctagaggaatatcagatagtcaatgaaggattagaatctgagcgaaatttttacttcaacaagctcagagaaatagagatccttgcccaatcttcgatggatatactgaattccaagggcacctctgggacagacaatatcgatgtcacatctctgttgaaacaagtccaggagatattgtatagcaccgaggaaggcttcaaaattccagacgataatgatgaaaatgatgaaaatatacagccatcaaccgttttggaaacgcccagaaaggaagatatatctatgttggatgaggaaacgttctaataatgaagcatgtggcgagagatagtgaaaaactttgtagagcaggcgtttgaatttcaccgtgcgcactatgtttattgcttataggacactcttcagtgtaaaggtcatgaattacgttaaccgtagcaaagtagccccaatgaaggatgaaaatatatgtaagtaaaattatgcaacgctagttgtgaatccttctaatcgaggccttcccctagagagaaaaaaattgcccatctcaccctcgcttcccaaaatcgttgattcttctttccagtggcaaggtaatgttcaagtccaaactccgttttgtttcgtttggtccaccgatcagacacctggctaggtcaggcttaccttcattgaaacttatgaacagcccaagttcaaattttcatttgaggattttgcttcgaccattctctgttcagagacttgcacaatttcaatcctcaaagttgactttacaagatcaggaatctaacaacaaacataagaaggatgacaaaaataagaaggatggtggcaagtcaaatttcagttttactgaatatgtgaagactaaagaatttagaaatacaatgattttgtcctttttgttgactttaacaatgagtttgatgagtcccacagacacctctaatcagctcacttttcaagacttcaaaaccaagtacttggagaaaggattagtaaagaagctgtatgtgataaatcgtaattttgtcgaagccgagctagtcacctccggcagtgctcactctatcggtatgaactcaaacactttgaatgtttttggcaaacaagttgtaggcttttctattggatctgttgagtactttgaggagcagttagaaacaatccaggacaaattgaatattccattggatgagagaatcccagtacagtatattgaaaggaccggaattctaagttatattcttcctttcgtaccaactgcccttcttctggggggtctatactggctaactttcaaaatgaaagccggaaagggtggtcctggtggcccaggtggaggcattttcaatgtaggaaaatctaaggctaagctttttaatcaagagaaagacatcaaagtgaaatttaaagacgtggcgggttgcgatgaagctaaagaagaaattatggaattcgttcagttcctgaagaatcctaagaaatatgagaaactaggagcaaaaattccaagaggtgcaattctttctggtcctccaggtactggtaagacattgctagcgaaggcaactgctggcgaagctggagttccatttttgtctgtttcgggttctgagtttgtggaaatgtttgtgggtgttggagcttcccgagttcgtgatttatttcagcaagctagaaagatggcgccatctatcatattcgttgatgaaattgatgcgatcggtcgagaacgtagtaagagtggttccatgggaggtaacgatgaaaaagaggcaactttaaatcagctactagtcgagatggatggttttgatagttctgaccatgttgttgtcttggctggtacaaacagagctgatgttttggataaagctctgttgagacccggtcgttttgataggcatatcagcattgatagacctgatattgaaggaaggaaagatatttataaagtccacttgcgccatattaagctggcagaagctttaactgatgagtttgccggtaaactagctgctttgacccctgggtttgctggtgctgatatcgccaactgttgtaatgaagcagcattaatcgctgcccgaacagattctgactccgtggcattcaaacatttcgaaatggcgattgaaagagttattgctggtttggaaagaaagtcccgaattctttcccctgaagaaaagaagactgtggcttaccatgaagccgggcatgccatctgcggatggtacttggaacacgcagacccgttgctgaaagtctctattattcctagaggtcagggtgctttgggatatgcccaatatcttccaccagatcaatttttgatcacagagatacaactattgcaccggatgatcatggctctgggaggaagggtatcggaagaattacattttccgtctgtgacaactggaggctcagatgactttagcaaggtaacaaatatggctactcaaatgatcaagaggctgggtatgtctaagaagttgggaactatcactttcgagtcgaataataattcaaatggatttcaagtacacaaacccttcagtgaatatacagctgagcaaattgatgacgagcttcgatccatgatcaactatgctcatgaaagatgtaaaaagttgctaactgagaagctacacgaggttgatctggttgcaaaggagcttttgcaaaaagaggtgataacaaggcacgacatgattagactgttgggtaagcggccattcgaagaaaagaatgaggctttcaaaaaatacattgatgttgagcttgggccaaagagtgcacctccccctcctccagaggagacttctgcagtctaaagtactcatttttacgtgtaaatagtagatagtaaaagacaaagtatttcaaagcaaatattgaatgaagacttacaaactcttggacttaggccaaaaatcaaaaaaaaaagctcgcacccaggttcgaactggggaccaacagatttgcaatctggcgcgctaccactgtgccatacgagcaaccgttaagttcgtagcctgtagaactatcttgtagtactattagctccaactttactttgagaagtaccattttgatatggtgactggctgtaaaagttcaggtagaagtaatgtcatatcattaaggaactatccaaaagacatagtaactgaacttttgagattcaaaacctagttaatttgagacaaacccagaatttcgtgctagataaaatcagtgtagtccattttgtcccattgtgactttcaaggatatgctcggaatcttccacaactgactagcctcaattatccaaaaattttaaatctaagaaagttacacaattgttggctccctaaatggcactgttacctgctgaaaccaaagattccagtaagggctagtcatactatttcccccatcatcattaagtcaccttgttcttcatcaaacctcatccggcccaattctgtagtcatgttataccctactcaactgggccgttttagtgaatggatctaaggctaagtgagacatatgcaggggatcaatgtacttgacttgttcatcggtcaagttcataaatgtactaaaagagccagcaatagtttcattaacttgaagttgaggtgaagcaatggggcttttagcaagagtcaacgtaaaaccgcgggatatctcctcaagttcagccttagaaacttgtagctgtttcagcttcacatccaactcagcagccgtcgaatacttgaaattactgtgaatagcttcatctaacgcaaagcattggctatcaataatgttgaaaggatcaaattcggtctctgtggcataaaaccaccttgagaaactagagaagtcaaaaaaaagttgacctaagattgcggacaggttggaattccaataatggacatatttgcttagtttgtgggtatatttggagtcatcaactaatcgtagcagttcggcattctggaaaaataataaagataattccagcttaagctgtttctgaacactgatgaataacgggtgatgacagtacttcacgaatagtgagcaaaccagtttgctgtattcgacaagcagccacggtttaaggagaaatggatcagggtatgtatctggaattcccagtagtttccaaacagaacaaagtttctccattagatcaatgagtagatgtacaaacagcttcatatgatcgtaggatagggacgtttctttgcgatttgacaatagagccgccttgaggtagtctgtcagaagaatgatatagtgactcgtcttttcaatgccattatccatcagattcagcaaactggaagattgaagatcgtctagcgcatattcaaacaccaagctagatttagagtcttgcattttggatgttagatggtaatagcgtaggtgaaactgaaacactggatcgtcgttagaagagtattccagttgagtgtccagtgggttcatactagacctgaaacgaaggttaaaaaaaaacgctttgaaataacccacaagattactattgctggtgttgtctgtttcgttgatcctgtccaaccatttgagatctaccaatgacagcaataagcaaaccactagcggtatattatcttgcgcttttatgtgcgtataaacacaacgccgactcttatctcggagagcttcccttatggcacactgagctcgtaggtctccgcttaaaacatatatggttagaaataacaaatagtcttcattgtatacgttatcagttagagacacaccaaacaaatggaggggaaccatgaaataatagaaacttttccgaaaccagccaagcatctctaccagctggtaatagttcatggaagaggttccgttagggagtttatacttatggtcaacgttgagagcgaccaaactattgatctgagctttcagttcaccaacttccttgttcagattctttatcagattgctccttttcatgggtatgataatctctaattcacactgcacatttttcctagagcacatagagcaggcattcggtttcctctcctggaagtcacacttgattttatgttttcgacatctggtacacgatttgagtttccgcggctttggatgatctgattcgcttttaccatttttgttaacgatcttagtgaccactggtggtgtagctatcatcatggagggatcggatcttaggtggaagtgttttctcacaagaaaatcattgccctggtttttgatctgcttttttcggagcccacgtagatgcatgaagttcctttcccgcatttcggaaatttgaccaatcccgcgcgtttacaatgtcattgagaattgttgcgtaatcaataaacgaaaactccgtcggagttttgggaattgataccggagacagtagttttcttcacagacgaaacgtgtattcgaataagcagatccgttagctgaaaaatgtaatttgaattggtagattcattatgcctgccaaaatgatggggcaaaattgtggcttttcgaagtgttatatgaactgtttcgcatctggaactccaattttgcgtggtatatttcacttttttttttttttttttttttttttcccttctatgcattctcaggactaccttttttttggcgcctggaagaaaactactggatgagactcacaggatgacgtcggatcaagggaggtacagtaccctttatttcccctaagtgaaactatctattctatctatctgccaactacaagctcggtaacaagtcctaatagttcttttttcatttgggtaatgttcgaagtttctgggtaactaatactctcctctaatgctgagttgatcactctgatgatgcattgatgtaaacaaaacccacctgcttgtgcatctttgttttgagaccaggttatgagttgtgaaagattttggtctacaatttcaaaaggtgtacctttgtttgttgcaaaattcgactcaattgttttcacttgacggtgccgttccataaactcttggataactttgtcctcccgaagttcaaccttatcgtgtatataggcaatcatctgatagacatcatttgagacaatgccaaatatcactttatgcatgatctttccttcgtttccatcgttcgagtttttctcgtcaataagaaatgataaaatcttcaggagggtgtggtaagtgtcttttaacaatccctgttccttggtatgctccagccgggacaaacggatttgaatttccttgctgttagctaagaatggaagtattgttaagatgagaaacggttgtactatgagctctaaagcgttgttgatgtgatcatcaaagttgatcaatttgtaatgtacacatgtgatgctttctttgagaatttgaggacaaattcttaacatacgagcaatgcttgtacgtttgatcaaactgtccgaaattccggtttcagcgtgccccgaaggtgggtttctcaagaatagacagttaacccattcgttaatcaaatcatcatcgtaagacactttagcataatttggttgtagagacgaaataaactttaggacaaacgaaactgtgtctggtctgtttgccccttttatggaagacacaacatgattcatttttaggttaaaatgttggtatatataggtcatggctagcagcagaatgttgaactcaaaatagaagtactgtaaattatcgtcatcatccataatgctattagcgtagtccgcgtctattgtggtgctatcgttagtattggtattgttgctgttgaaagataaagaatctatgtcccatttactagcatacgtgacaagttttcttaaaacaatgtatggggaatggtaaagtaaaaacgactccatcacacgttcattacccaaacagctgattaacagacgatttaatctggaggtatcattagacgatatgaacttttccaatagcatgccaaactcattcagaaattgtaacttgcattcataattacgatggtgctcatatgagggaaagcttctctctaaattcactaagatttcacattcttccaccgatacaaactcagggttggtattgctgagcgtttctagtatgaaagacaggtcatgtttatcattcaatatctctaactgagagctgctgagtttttcagctttaatgagatccatggccgcacatgaaaccacgaaatgatctttcacaagaagagaagtggtctcaaatgagttcataatggtccaaagtgtttcttggttaaactggaacactttctgcaccagtaaaggcaccttaacaacgataaaatggtaccagacatcatgtgccagcttttccatttctttgtccggagtgagcatgtcaatgctctcaaagcaaccactcaaaagctcatacaaaatactgctgctaactttaacgtttctaagatcgttttctgaaacgttcagtatcttggtaaatccattcaaaaactgaaccatttgatccaaagttttcaggcatgcatagttagtaacaacttgatagtccagccacattagctttttcagtctgaccattctcaacgtattgaccctagtcttctttatttcttttctacctgtaaatttagctgtgaatctcttcgtaatcgctcgaacctggtttcgaatcatttcaaaaccttgacgttcactaatacaatcctggatgccatccaatatatccttcactatttcaaactgtttcttatcttcgccattatcacatttatcaatcagattatcaatcaagttgagaaaggagttataaactcttattacaacaaagtggttgtccatgatcccgcccaaatacttgctgtatacattcaatgcacccagtaccttgctccagtattcatgttggtaaaagtttttgaacttccctttgttgatcgatttactgatcttattgactacaatgtactgatcgttcagcctcaacaacggcaaatatttagcaaacagcttgggcatagtaatcaatcctatatccgagtcattttcggtctctccattctgactattgacgctatctccttctactaataattctaccagatagttaagtttgaggtcgctggaattgtcattttggtctatccgattaagaagatcgttgaccacttcagtttctgccacttcgccataggagtcaacgtcatgaaccagttgtttgaacaaagaattgaaaagttggggattgcttcgtctggctacacatacctgaacaacagtgcccaagctgatcttatccattgacgaatctgcgctggatggttttgttggggttaggtttaactggtggaatttcagtatattggacccacacacgacaacttttgcgaagtcctatatacgatgatctcctaagaacatttagtatttactaattagccaaagaagccatgtcgatatatcgtatcattcattatgtatgttgagtattacgaagaagcttgttaagctcgctgtcatttttatttaaaagcattgaaatgtggcctctctcgatgacctcgcctttgccattgaacacgatgcattcctctgccatgcggatagtgcttaatctgtgagctatagagatggtggttttcccttgagcagaacgctcgctgaatattttgtgtatagcagcttcagaggcggaatccagggcagaggtggcttcatcaagtacaagaatatccggatcgttcataatggctctagcaaaagctagcctttgtttctgcccaccggacaaagtagtattgatactgctatcaaccattgtttccaatttatgaggaaggttgaacacgaaggaacaattagttatttctataacatgatgcaggtgctcgtctgatatgcttgaagcagtctcttcatcaagcccgtaaagaagattttgttttattgttccagctataagtacaggctcttgttgcacgtatccaatatgagttcgtaactgttgaagagagatctgagaaatgtcttgcccgttgatgacaattttactggattcggggatatcataaaatttcaataaaagagatgcaatggatgatttaccacatccacttggtccaaccaaacaaacatgagaatttttagcgatctttagatccagatcattaaagatagtgacctcaggtcgacttggatacttaaatgtcaggtttttgaagtgaatttctccattcaaattgactgggccggcaacatttgtaggtgtttctttagcagactgtactttagactcgttaagcaaacttaatacccgttctgaagcgccaacgcccttcatcagttcggtgtaaaaattggaaagttgaaaaactgatgatccagtatatatcccatacataagaaaagaagagagatcacctaacgttatctggccagtcttgatcatgttaacaccaattatcagtagcaaaattatagtggagttgcctatgaagccggttgtagcataaaaatacccagatactcgagcttcctccatagatagtttatacagttctgttgcttcatgagtgaatgctcctatctctctatactctttgttgaaagattgaattgttttcactgaatggaactgttgctcgataaccttggtgagatttccaagttgttgttgaattagctttgatacagatttcaaacgttttcctagaaccaaagctaacagggctaaaggaggtattaccagaatcatgtagcatgtcagtttactagagatcaagaacatcatggttagccctactaaaccactaatcattgaccttaacccatcgttcaaattctgcgatatggaacggctaataattgtcacatcgttaacgatccgagaaattagatcgcctgatttgtgaatatcccagaagatcattttttggcgaagtaaattagatacgagactgactcttagtctcttaataacattttcaccaatccttctgagaatcaaaattcttccataattagcaaacgatccgacgacaaagatacaccccaaaccaatgtaaaacgtgtatgatgttacttcgacactattgaacaggtttatcgtatcactatgaatatcagtagagcaagtgtctataattttgccaatcaccgaggggaacatcatgctgacgccagatgttataactaggcagcccaacgcagcaccaaaaagcttcgcctctggcctcgctaatctgattaagttaagtacatcttttggattggactgttttgatgatggtattggtgccgtttttctatcggagaagccagcggatgaagaagtggaactatatcttttttcagggagcagctggctgggttgcgacatgttgtaattggtatagttgccatgccttaattcattataatatcgattgccaactattctgttagcaaatatagctcgacggtatatgaggttgagcccggctctagaaaccgagatcatcttcttgctgatctacctttaatggagaaaataaggttgactgcaccgcgaagaggccgggaagtaaaacagtttcggtgtagggatccactaggatccactaggatccactaggctcctatatgtgcctcgattaatgcaagatgcccatttagtcacctttgactgctctatgatgtcaattgtcacagatctgcgagacagtgagattctattatggatcccaaaaagctatggaaagagaatttatttcttgtcccgcaacccataacttattatcaatgaaccgtcaacatatggtcctcttccagtgtaattaatactacaggatcaacacaaaatgttgatgcatttgatttgagctggcgcgtgaaaaatgcagttttgtcgatcacgaaagaggcaaaaatttaaacaatgttgataaactcatgtgcttacatttactttgtagataaataacagagtactatttccaatgtggtaaagagaagaatcaacatttttttgtcttcatttaatacaccagatgctagtcttcaaccgattttgtcaagtgaggcataatcagttgccatgccaatgcattctagtatgcaggaggccttaatgcaaaaccttaatttggcaatactaaatataaacttaagaaaataatgtagcatgcgaatatttctattattaatacctgactagtcaggtgtcgttcaacataataggaaatagaaaatcgaacttttcttcctagttatttattttacaagccgaagcataagtttgatcagctcataggcctgatccataattactgaacccatgccgattccagatattaactacaattctctgttgttaagggaacatcaactgtacaatagtttgcgccagcatgccaaaataccacttgagtctccgaggttgggatttaagccaagccatatttatgggctgggttcgttcaactacgaacttatcgaaaacgaaggacagcacctaaactgctctgagatccgcaaattatcccaatgtctcttggttgcatttatcttcatggccattctaggcaccactgttttgtttggtatgagaatattcaaagtcgaatccttaaaggggtataaacgacttcaacatcaagctcagacggttaggactataaactcatgggtcaacgagaacactaatcgtttcaaccttgcaaatgaagtgccgccctctctgtccaatacaccgtccacagtcgctgatagctctccaaatggctcccctgcgttgtctccgatcatgattcctcaagttaatcaagtgagaaagcacagcgatctttacttgtatgattttgccgcccagcgagtataatagaaagaacatttgatcgattgttactttttcttttgcatttatatagctttctttggtacctgtacttgctatgcactttgaacgattgtacttggtttcttttatcattttagaaatcttaccattgcatggttttgcacaatagccatagatgcattttcttatttaaatttcgagttatagtacatactaataagatactattgtggcttgactttgactgactcctactaaatcaagtgcctcgcgattcaaatctcaaatctagtgactgatgcgcgatctttcatcgttcatatctacctcaccccttatcgctgtttcctaagcctaacctgtagtcagcattatgttgtctttacccgatgacattataacctttatgttaaatgttaaactgctggatagaaaagacttggttagcatatcaatgttaaataaggactaccggaaacgttttgaacctatcctgtttgataaaataaaaatgacctggagccagttgaattctacctcaaactgcagtgatagtaagcagaggcaaccattacaaatatctcttcacagatgctttgagtcctttatgtacaaagatttagtgtcatttattcgcgttcatagcgatatgcacaacttcaagcaaacttcatatggcgaatggaatactgatttgtcacctctgaatgattgcaagtttctcaaaggtttggctattgaagttttgacatcttcccgatgcctcaaatatcaatcagcattagagagaagtcaaattgtatccttgagaatctgcagccactcaaccaccgatgacaatgcctcgctttttcaacttacccatatcagcacgcatttcccaaatgtatctaagctgactcttgaaggcttcctaatagacaaggaccagtatttcatgccttcactgaataacagtggaagactttccaagcttagagatattactttggtcaactgtcagtgggagtatcccttatcattgtttgatattttttgccctttttaccaccatagttctctatacacaacgtcaaaaaccccagagatcatacaacctacaagtctatgtctcaaatacactaacagctattcgtccttcgttttgagggaacgtttcaaaactttcattaacacaacggcggataaagttggttcctttaaaagctatcctgcattttattctaaccttaagcatttggaaatatcgattctcaacgaggagtaccacacacacacatctgagtattattacccaaacttgagctggttggaccttactgctcgcttcgccgaagattcatctagctcacttatcaatagcttgagatccttaaagttagttgggtggagggtgaacaatctggagctaattaatcagctctttggatcggcattcaagcctggaacactggaacggttcaacttattccgagttgatgacacagattaccctggaaatcaagaaatttatgccttgatagattcactagtgaacaagcctttttcaaatcactgcaaaatctctgttaggtacgtcaacgaattgatgtagaataataccttacataataatacaatcctgcaattgtagcccatagatgattttgtcaacatgttttttaattctttcccagtctgctctcctagtaacgaactcatatacttcttcctgagtaaacattccattgtcttttccaattctcactaccaattttccgatttcgtttgagttctcgctatcaatcaaatagagctgtgcaatttgccgcagtgctataaagtagttcacaattggttttagttttaattccaagaaaaagttgtacataaagtttaggtcattgataagaaacattgctccgattgtgcttattgttagtttcttattaataagtttaactagatcgttaacaaatctctcaccaatctcttgcctgaacacatcaataatggatttatcaatgcttccaataagcatattgacatgaactctgagcacttgaatagtcttctgggcaaaactcgtgggaacacctggatccagatgctttctcaaaagatcctgttcattcctaatactatagattccctcatctaattctaccatggtgatataactaatttcattcataagaacctcgataccagtattcaggccgtcagccacatatgtgtccaaaagagtttccagtttgctcatagacttttcacagttattaaccattaaaaagtcctttttactcttttcctttgatatcaccaaatgtttatcaataagttcttcttgatagaatattttcaacatttcgttaactaaatcagcattattgaccaattcgacaaacattttgagtggctctacagcaatttgtgcaccttgatcaattggattgtatactttcagtctatggattgcttcatcaaatcctatctttacgtgcccatttgttaacgtcaccacactatcagtgaaaacttcttggcaagttgttgcaatcttcttttcagtttccttgttgagatgtgaactgtcacctagagagagtaacaataggaatgtgtttttcacatgttgtaaaatcaagatcgtcaaatcgacgctaacgagagatttaatattgtcaaggttatgagagagtatctctaatttggccgcaaatctagtcagacgcttttgctgagcattctgatcctgactccgattcgaatactccagtgtttctgataccctctgagcctcctctttttgaacactacctttgaaaatgctagtgaatccagtcaaaatatctttgcctgaagttagaagaaatcctttcttcccttttgtatcctgctcctcgtccacaaactgcattatctcattttcttgagactgttcttgttttttaagttcctcctgccacctatttatcaattgaatcaaagagaaatgacactgtcgaggaagcagatcaataaattcggaggaatactgaccatagtagaaattaatcaattcagatatcagtttggggtagtcaataatctttgaatccgcaggataacgaacttttgaaaaagtaagagatatcttgttatacaaataaggcaccaattgaaaatagagagaagattcattcatcacattgaagtattgattttcactaattaatccatttccatcaccgcaactatggccccctgagatttgagttgaatttgaccgaacacaattattttgagcccagggattctgagagtcttcgttcaaaacactatctgaaatacttcttgcttgaactagttgattaaattcaataatttcactttcatcaatttcttttgcccgcgttatcaactcgtcaacaaaccttcctattaaatagttattcaaaaatgtttcaaccagcttcaacactataggaacttcactgatttcaccatcaacatcaggtctgaaaatgtgttcaagtatagtgaactctctatcaaaaatgactatgagcttttcaaaaacctcatccagtttcacaaattgcagttgataacccttgaccacccctctttcattctgtagagatgtaccaataacgttgagaaatatgtccgtttcttttacctcgtaaaggattgaataatcgtcggcaaacttgttaatgaagaattctaagattaattccatgttgtcaacatgatcaccagttctagttgttaagtcaaatgcaggctctcccaaaaggtgaagggagtctataagagcatgacactcctcaaaagtttcattggaaaaatgatgatctatctctcttaatagactacttgtgaacatttccacaattgaattgagacgtatttgcaatttttggtatagctgaaaattaacattcttgaaatacacaacaaattttcgaagtccattaagcaacaatgcttgatccttgggagaagtgattttctgtagaatgctagagttttgaatattatcatagtgtgttactaagagatcctgaactattggtttatacatagtataacagactttgaattgttgaaaagctaacgagggattgccaacagatatcttcatactaagtagtaaatcatccacaatttcggaagtttcaaccttaccgttcttccagatccttatccgcttcaaaaaatttatccataagacctcgtctttcattaccaagttataaacttgcctattgattatactgaagttgagaacgtccttgacatctggtaggtttcttgagactagtttaataactaccaaaggaatcatgttgagaggtcgagtggaatgtaacaccaagagatcggagttttcaagtaaggaccccgataagagatcggccattgaaggaggagggacaaatggcagggcaaactggtctagaaaagatttgaactttaagtgtttctcgctaacagagttcccccacccagtccgttcttgatgttcaatcgcggtagtgcatcctgtttatttacaatccaatctaccacgcttcctaacagggaacctgtcgactatggctgttgattttgaccgtatcttccacgatacaaacctcactgatggggttggtgggcccaagatatatgcttttgattccaccttaattccaaaacgtattcttgataattggatagaagacgacagtgatgaagaaacaaacgctttactgtcccaactgatggcctacatacctaaagattgtgctttttctcttctggtgtttagtgctggactgcatcaatcatacaatgatttgatagagatggaatacgaaagtcatgtgagtgataaattcaagcagtacaaaagcaaactaagtttaatactacccgtcaggcttttcaaattgttcaaactagtcccagaagctaagaagaacaggctaaaaagagtctatattattcatgaaacatggctgaccaagaatatttttgatatttggaagactgacatagagtttgtccacattgggaacctcagtcaattggctcaatataatctagatatctctaaaatggttatatctttgcctaattacatcattgacagacatataacggagtcatcaaaaattaatgttttgaacaaatctgaaagcattggctttggtgctccattgattgccgatgaaaacgacgcccttggatatttctccagaatttacaataacatgatagcatttttaaccaacccagaacttagcatgcctctcaccaatagggactgggcacagattgttaacccagagggactcttgccgaaaacattcgtgaacattgaggttttatacaatgcgatctgtcgaaatcagtgtcttgatctcagagattggtcgtttgctgaacattatttaatgcttagcaatttcattattcaattatccaataacagtcatccactgatacctgttagtgttctattggagtatccttcattccataccctcgaagaactgaatagtgttttgcataaggtcctcatttataaacacgaaagccccatatctgggacccaatataataacaagtatttgctgataaaggtgctcaatttgttgcattacttgacactcaagcttgatcaggattttaatcatgtcagaatttcattattcaaaaggacccgacttagattattcctttcctttactaaggtgttctacaacgaaatgggatgtgaaactgagaatgacgtcgatcaagcctttgataacatgtttaaattcattagtaatcttttacaaaactgggatcatattctcatcaatataaatggaaagttgagagtcccatttgttcagataaccaagttaattgatatccaagaaatgaaagaattcaatacatatatgaatcaacagcttgtgattccagaagaaagtagtccgatattaaacaagttcagtacaaagctatctaatccgaaacttcgaaaagcttctccttcttcattaccatcgtttcatagaaatgaacaagaaagtattgttgacttggcattgcctttgcaagattcatggattgattccgaacaaacctcagtaccagtgtgtgactttcctgagcccagcaaaaatactatttcttcagacaagtttcctcagtattcaattgagaaactcaatgacttggaacttgaacccattgcattaagaccagaagtgaaagtagtggagaaaaacaagaatattacccctatcaaaccatcaaaactcaaatatccagcgaagatcaggcaaactgataaagatgccaaagttttgcgacaaatagaactagacaataattcaaagttgcttgctataactactggtaagaaactaagaggagagagagtttctaagcttactggaatctatgaaagaaaatatttggaattcatgggatatcaaaataatgaggaatgaatgctttctatgtacaattaggcaaggtcaattcttaactggttttcacattttgttcagcagatttatgtttagcaaactttcccttctgttttttctgtggatactctttgctatgtctattctgatttcattggtggttcggccaataacacgcaggtaatcctgacaccatcgttgtatgcctttgaggtattcaatattgtcaatctgtttcgtattttgatcggatttaaacttagacatgatattatgaagcacagattctacaacaaaaccgtctatagaactgggaatgtatagcctgacctcatgtattggtaacatgtatggattttgccaaggcttgtaatagtgtagagtattcccattcagttgtgtcaggttcctagacagtaataaatgcgtgcatttcaaggggaacttcttgagaacatacttgatgtatgaagttgtgtaatgaacccaaaattcatcgtcccttggtaggattggctgcatcaggttgtaaatctggtcaatccggtcaaagtttatgctatgcgagtctatcatgcgattaatgattgttagaaaggtactttttgcaactaacggacaaacagaagtggccattgaccatatgttatctaaatcattgtttgttcgaagtaaggtccaggtaatctgattgaactcactgtgattgaggcctccaaaatgagaaaatagtatggagacaactttttgaaccccctcattatcattcagtaacaaatacagggataagatggatgatagttgtcctcttgtgaatccttccaaggattgaaactgctctagctcattaagtaggacctgggctaattgatgattgttatgtcttgttgaatgaaacatcaatgattctaaaagattcggatttcgcaaacacgctgatactggaaggtcctcaattagctcttcaactagatatttgtactttttggactttgagaaagaacgaatagattttgctagtacctcgaagaattctcctgagaacgtagttgatgaagtgttttgttgtatttcatgcaatgatttggtatagtaagtttttattgtgctccagcctaaaaatacggaggacaggttgttatttttcaaattcgatgaaatgtaccgcaacgaatacttgaacaagaagctttcctgcatggttgatattctgtgatgttgcgccattgacttcacaagaaagctgaacacttcggattttacacgaacagtcttcggagtatcgcacatgtgcgttagcttctctagtattctattcagctgcgtgtcagaaaaataaaatcgcttcaagctgacaacaagagggttgtccaactctttcatccacggaagcccattgattctaagagagacttcttcaactatcgaattatgcaaggaagctaacttcacaacttttgacaggttatccacgtcaaattttggattgtttaccagtaaagagttgaccagcatatgcagccagatatctttcacaagcaattggtccaccagtggactgttattatggaacagcttctttacagctctaagagctgctatatatatatcgaaagcaattctgggtttgttgaagactatgcagcttgtgattaagatttcaaatgctttgaaagtatctattttttgaatgtctagaagcttaggtgatagacatgatttagtcctttttaaggagattattttctggcatcttgattttatttcttttatatctggttgagcatcaataatcatcctgccaagttggattagctgttttctgttagagaaggaactctcttgggaataaaatctagatagaaaaggatgccctatagctttgattcgaactcgatgatgcactaaacgccatgtgcaaccacacagtcccatgctaatttgactattcgaaggtgctagctttggtttcaaacacttgaaagttttgtcgcggggaaaaagaattcaagttttagcgcgctccagaaactaagcaggttagtcaattccaccagtaactttccctatatactcagcttttgccagatctatgttttggagtaaggcaaaggacactatagttgcaaatccaactaccataagtcctagctcattatctcctccaacaacatctgtttcgctagagactccaatagtgagaccttctgattttttcaagtatggttttcctggtcccatccatgatttacaaaccagagcagaatttgtctcagtatacaaccgtcaaacccggaatccatattatgtcgttgaacatttgaccccagattctttagccagtcacaatgctgatagaaagaattctttttttaaggaagatgagcaaattccaagcatatttagggcaagattaaaggactattttcgatctggttatgatagagggcatcaagcaccagcggcaaacgctaagttctctcaaaacgcaatggatgaaacttttttttgaccaacatgtcaccccaagttggagatggttttaacagagattattgggctcatttggagtactttactcgtactctaactcaatattttcgatcagttcgcattgttacaggtcctctttttttgcctaagcaggatcctaatgatggtaaatggaaggtaacatatgaactcattggaagtccgccatcagttgcagtgccgacgcatttctttaaattggtcgtagccgaggacccgaagaatagacgaaaccctggtgatgttgcgctggcagctttcgtccttccaaacgagccaataccaaattctgtcaaactcacagattttgaagtaccattagaagcattagagagagctacagggttggagtttatgagaaaactggaacctcaaaaacagaagcccctttgtaaggaagtcaaatgcgaactgattattagagatttcaataataacataaagcagctacccctaccacagaaataggtgacttgtgagtcggttcgtactatggtactatttagtctaaaatattccaattcagctcctaatggcattctgtagatcgagctcaattaacccttaacatgtattatctcaagcattagttgtgtgatactctaggcaattgactactgggctacctacatgccatgaaaaaagcaacaagaaaatccccggtaatcttgtaatgagttccaggtcagtgaaatcaggcaagagcttaagttaagttacctttgaacaggcctcagtttattaaacttgtttctccacaccgcgacattgcacgtgatctaatctactctccttctataatcagtctcaagttcgccttttttcgcctcaacatattgaattatgagataccaggaggttcatgagcccgaaaacccattctcacttctagtaaaaggtcagacaatagtggaaatacctcaagtgcagttggaaagcggcgaaactttgcacaatgttccggtagctttcaaaacctgggggaagcttaacaaagaaggcaccaattgcatggtgatctgccatgctttaacgggttccagtgatgtagttgattggtggggacctttgttaggtaagggcaaggcatttgatcccagcaagttttttattgtgtgcttgaattctttaggaagtccttatgggtcctgttctccagtaactagagatccggcagttaatgaactatatggtccagaattcccccttgtatcagtcagagatgatgtgaatatacatagactgattctaaatgatcttggtgtcaagcaggtcgcaatagtaataggaggatctatgggtggaatgcttgctttagaatggtgcttttttggtctatcgtatgtcctcaactgcgtcgttttggccaccagtgctaagcatagtgcatggtgtatatcttggggagaagcccaaagacaaagtatatacagtgatcccaaatatgatgacggttattacccactggaagatccacctattcaaggattgggagctgctagaatgagcgctttgttgacttatcgttctcgcaactctttcgaagaacgttttggacgaggagccccaacgccacaaatgagagaaaagtctcttcgaacttccgtcataactgatgccattgaagcacctgctgttagcgaagataactgcgctgtacataacgatggacattattcatactcttcatccaccaaagttagatcaagatctctgtcttcgaacaattttagtcttttagatgtgaaagaggacacaagtagtattgtcaaccaacatggcgttggtcaacgtacccgccgtcgtccacagcattatttttctgctcaaagttacttaaggtaccaggcagccaagttcagtcaaagatttgatgctaattgttatatatccattacaaggaaattggacacacatgacgtgggaaggaacagacctgaatttcataactccacaatagaggctctccaatcgttagaacagaatttccttgtagtaggcatacaatctgatgccctgtttacatactcagaacaggttttcatagcaaaacacgttaagaattccaagttatgcaaaattgactctccagagggccatgatgcgtttttattagagttcgaagcaattaacaagctgattctagaatttgaaatcgaacacgttcctgaacttctaatgcaaacctccgacgattcttggtcggattctgaactaggaaacactaaggagagcatattcggtgaagttgaggatccgacgtcgtggtaagctacaaagtaaaaatttgcctcacgctatttgctctggctgaaataataatgaccgtttatagaaaattaataatggtaaagtttttatcattctttaacgagcctcaatctgtctaaaacttcctgacggacttcgattatattccgtcgctcggaaggtaaaaaaagtgcaacgatgaaaaagttggtaaccgcaagcacagttattaatgttgacgtgaaaagaaaaagaacactagaccatggggctatgaaagagactaatgttacggaaacatgcaatccaataatgactaaaattgaaacaaagacgtgaaaagatctccattttacctgacgtctccaggttttttgataagcatccaagacagcaataatatcacgatataatgctggttcagctgcaatagaagacggtgacgatcgagatttattaaaaggagcatccaagttgagtatttcaagtgttgtcgcatatgcaaaatgatctgaataagatccaacgttcggaattggggtggtaaatacaaccttggcggatgtgggcttgatacgatctgcactcaccaacgcaaaatcaagccttgcggcactttgaggggcacatttcagccgccaggtattgagtaaagaatcacaggtggtaccagcagtaataacttgctcttctggtgatagctgcgccactactttcgaatctatggtgccatgtaccaattcccacgaatctgaaagttgcccaatttgctggaaaatacgatatggaatacttcctggtcttgaattcaagtcaccaacgaccacaacagcataaccgcttgagcgtaacgcttcagcaaggtgagcaaaatcccaggcctggcaggttcgatggcataagtagctggcgctaccgttcagggcataaggagcgtgcatgtgagagttcaacaaagcaataggtctgccaccttctctcaacggggccagtttgataacgcctacacttttgccgacataccagtcgcccctaaagaatgcagaaggacttccattgattggaaacctgtacaaaaacgtggactctatgggaatacgagacagtacacacaaacccggaccagctattataccagcataaaatctgcggctatgaggatacttcttattgcactttgtcgtcaaatattcccagtcttcatcacaccaaacctcctgcagagcaacaatgtcataatcatgtttggtatcatcagctaattcatcagcaattgctcttaacctttcttgccgatgcttagatacgtacttcaaaccccaagtgttgaaagttaggagtttgagagacataaatatgaaacaaaggtacacaagcccaactagaatttggatcacgaataggacaaaaagcgcgaagatatgtcaaggtgatgacagaaagcaaagagcagactacgtatcaacatatagatgattcacgcagctatatgattcctatgccatagcatttgtcaatctaccaaaacatcagtaagaagtatactaccagactccaaccaactttcttatatagtctgttcccgatgaaaacaacataaatccactttcaaactcgcgaaatcaacaagtagttaattaatgcccgtgtttatttatcaactacacattctttaaaactctgataatcacactttcatttcggggtaattaagcttacatgtattgttaaatgtcacccgatcctttttcagagttttcttttatgaaaactaaattgattggatttcaagatgattttggctcttcaacacagcagcttcataatcaactcctgaatgcacgacaagagtttcaagaaaacataaatcacctaagatatgagtgtttgaaaatagaatccgagatagattcccttaaattgcgtgaagctgaaattgggcattgcaaagaaagagaggtcacaaatcttgaagactctaaaattaagttcaaggcacttcaattgaaagaagagaacttgatattacacaagaaaacactaaacgaagggatttcagctttgcaaaaacaggtcgatatcaagcagaagcaagtgcatatacataaacaacagatactacaaaacagtgagctcaatttgcaggaaatgctgaagtttgagaagtacctggggttgagtatcgagagcatcgctgacgatgttctcaaattctactttatcaacatcaatcctaaagattaccagaaagaggttacatttattttggaaattgggaaccactatgttgtcaaagattgccaaccaacgttggaggtttgcagagtcaaagaaattgaagaaaaatttaaccataggagagatttaaagaacttcttgaaagacatgagaaatgcgttaaaagacaaattgattggattttaattgcttctacattctgtaatcgctctcttaatcatctgataaaaaacgtcccggttaaccccgatttagtatgcgtggtgaggcgggtataaggacgttattattatatggtccttcttttagactttccttttgttcatcgatgtgttcagccaagtcaactttgtgtctgtgtctcttcttacgggcatggtaaggggtagctatcaaaggatttgaatcatttgatatggggcaatcaagctgtatttttgtagatactttcgctattgacggaggcatgggaatgtcttcatgtttactggactcatctatcttgagttgattttttaaattatcagtaagatcatctgaaaattgatgaagttgtgaatctgtgatagtgtccgaactttcagaggaaacagccttgccgtccaaagaagtcaattctctttttgtgagttggctcaattccgtctcagcagaattattagaactcagagtaaatgattgtttaatcggtcctgtagcagcaatttgattttgagcttcagatttaacctctggtattcgatgcaggaaaccatatcctacgtcgcaaccgagcaatccaatgccgccccagttgcgattaggatatatagtgaccggtcttaccacattgtgtatttggttgtagacgtataatacaagggtggcattctcacgattggtggagtaaacagagtaaagagtctgtcccaaaagctcttctccgcccatggctaacagcccatcctgggcacctatgatataatcactaccaggtagcaaattagcggaatgtccaggactgttaggcaatgtgtctagtacatgccaaacataagttgcagtttctaatgaagtcagttgaacactaattcctaattttttgtattttgaaaatcttgctacatttgagttgtcatccaatttgatttcttcaagactttctgtttcatctgcatcattattggagtacgttgtaaagggaacagaaatttgtcgaattgtacctcctttggcactccaaactgtaaacacaagatctcttccgttgtcaatatttgcaactaccatttctacaaattttgaaaagtctttattagctagttgcctgacttcaaacccatttagtgacagaatgtagtcaaaccatgactcaaatcccatttggtatccaatactttcattttcgacattcagtatacgcagcccttcattgatatttccggccaaactgaaataatgatctgtcgctaatgatgaagtaaatagtcgtttagcaagactgaacatgctgctcctggttaaaaaatctcagatgccaataatctgtttgtagatattgccctacgcgaattagtggttttattaagccactgatcagaaaagtcgtcactaatctagcgttattctcctcctcagagattagtttttttcttttattgttactatgggagagagaaatgacctgagtgaggttatcaatatattcaaggatgcagcgtctatgagtgacgatgtttatcaacaaaagagagaaaataaggcgaatgaaattgcacatacatctctcggtaagtttcccaaggaaatgtcatgtgttactgcgatggatgagctttttcagtgcttctcactgggaggacaaataagaaacttctatcagtatggtgacttcacgatgtgtgagagacaaagttcaaagttgagattctgtcttacgatcactgggaaaagtagtgacgagagagaaagaatgatccaaagattttatcgtgatcgattggtcgatgacaagagacgtggaagtagcgaagatgtttgggaccagagataaagccatatcatcgcttttacttagccaagttgtgacttttgtttcatttgcgaacagttacctcaaagctggccaaaaagtactgaagtttgacttctggaaggttctgaagcttttcacaagaacataattctgagacattcattcgtacctagtaaaatactttgaatcaatatccgaatcaaacgttcatagttctcactagagactaggcaaaggtaactcaaaaaattttcggggcaagcttatgtttaataaaaacattataaatcttacgcagctacaaattaacattatcaagcacactcttgacacatgagtgaagttgtgcatcatcattattcgtcattctttcggcttgagcagtttttcgatataactttgagttgctgatgttgattgtagaaactatttcccaaaggtctattttgcattttgcccctcagatgacagctctctttgaattcaacattttgatacaagtcagcttttatcttagttgatagtgggtttgtaataataataagtaattactttggaaggatattaatctttcaaaccttgttgtgagaaaaatatccctgtccttggatctgaggcttcaacaaaaaaagaaatctctggttgtgaggggttatgaccatcggtcagccaattcttgcttgtacgatgaaatggttacctaatgaagatgtcaatactttgggatccacactaaacttcagcctggtaccattaagccagaaattcattggcggttctaaaacaaggtatatccttctaacattttgggcaatcacaacgcccttgcaattggtgcataaaaacatcaacttaaacaagcagtgcgttgaggtttctgcaattatgatctaggccggcgtctttgcagatcaaggcaattatttgacttcctaacactaatagaacctggagcgcgccagtatcagttatcgccattaaatgggattacatttcgcaattgaaaaaacacaggcttaagcacagctggccaaaaagcaagctatgacaacagcaatcttgaagcctgatgaatgcaagcgtttttatcatttacttgaaacttactccaataaattgagtttttattgtatgaagtagcagtcggcatttgctaacatcccatcccccatgtagcataacaaacagcttttcttgctcctgtcaaagaaattaaaaagcaccatttcttcaaaaaaaatcactgtagctcgccgaaaaagacaatcttaactataattgtgaaacataggtgtaagaaaatgacacccgagattagaaggagactgctcttttggtcttcaacgaaagcgacatcgttcaggtaatgatagagcttacttgatatgttcaagccactgaaaacaccacccaagagaatgacaaaccatttcagtatcatactcagtttgggatgccctggaaaaactgctcttaacacggcaaatagcgaagcaggtccccatatcacgttagcatagccgtatattgatactaatcggctatagcaaattatttgcgggatcttgtaaacgaaacgtgtcacggctataaacagtaatggcaccaacaggatatagccatagagcaagttaatagccctcagcaataggccagtataattctggttgatgtctttgcctgtcatatatacattcaagatatctgatagtgtgttgctgaaaaacaagcaccaaacaattgtagcagttatccatactggcccatataaatctccggtgctattcatttgggcatctgagagttttccaataggattgaaagcagcagcacactgagagaaaaaatcgattgtattcaattggaaatatttgcgatagaaatgcaggctaaatggactaaaggagtcattaaatgctgaatattgtgccattgtatgctgctgtgacatttcctacgacagcaatatttgagtgtgttgatgttagtgaattgggaggaagatacaaatcaggaggattttgacgactcttcgcgttttccaggatacataatcagttaggcaatagctacatgaactgttagatcttttgaatcttcctgtttttagaggatggcgcccacttactggattcgccgtcggcttcactcaagcatggtagcaaaccatattttttctttcaatgcaaccaaggttatatcgcaacatctagagaagaatgccttttgcttcacaagtacgagacaattatttgatggcggagaatgggaagacgtcagacattttagggaacttgattcgatgccttttgatgagaacgacgaagatatgctgttgcaaatgacggaaggtacagagcggatgggcgggggttattcaagcaggcaaacaaatgccaacccgaatgaacataatactacagagtcagttaaaaccaccatcattatcagctacactagtatcatggtagaatcccaaacgtttcaatttgtaactccgattttaaattcaagtatattacggtcgccagataaccgaagtgatctattggtgatttgcttaaagaatcttcagctactattagtagaagtactactacaaagtgatggtgaattcgagttaaagatacttactagagtatacctagaagaacctgaagaatcacataattgcaataggctggagtcattaggtcatcatgtagcttgcaactctaatggcaaagtaatcgccattacgggcatgattaacaaagttaggttcttgaatttgtatccttctccccgaacaattaattgctatattgaaggacctattttgcaccaatgctttcttgaaccgtttgctcctgaaaatctgcaaacacatgtcatgtaccttattttatcacaaaatgttgacaaaattttgacaatttcattgttggagtttgatcagctaaggttgacagatactttcacacttcataggccactattacttcctcgagattttccacttccaaaatttgttatacctatgaaaagaacacatggtgtactattatgtgcggaacgcctcctttgtttcaagggtgtcaattctattctgagccaaactggattagacgacgtcacagtttatttagaagtgtttaaccccatcagttattttgttttggacagtcccattgcttcaaaaaattcagagaatgaatttttagatcaagtgataataaatgatgccctaggaaatttttggttagtcgagtcttatcggcaagatagttttatttggaatttagaatgtgacaaagttggtacgttttgtccaatgtcatcgtttgtactacaaaatcagaaaccctcatctttcaaaattttgtatgctaaagactttggcgacatttctgaaggtctttttgatttgaactcgaataacaattactccattacgaagtcaaaaacgaagattttgaatacgattcccttactggattatcagctcgtcccatctccaaacggaatacttcaccggacctcttcttctcagcagctatggtgtgttggaggaactactagtttgaaaagtcatcctgctatttggaatatccatagagggatttctgcaagaattgttaatccctcaataccattcaaatatgcagacaaattatattactacggaacagtagatgatgctatatacttcatcataagctttccaaggcactcacaactgcattgtctcaacatcacatccgcagtaactctaatagaggatttcacaattgatagtaaaacagtcttgttcgaaagtattggagttgattgtgattacattttagttacggagaactttgtcagaattggaaattttctggacttggactcttctttacaggtcgagttacccgaaaaaacgctattagcaagtttcaagggcggatacctggtattgacaagttccatggaatcagaaaccaacttaatggtttacaagttaaacttggaggatttccagttcaaatctacagaagaaatttttaaacccattccgctcaataccctacaggacatagagccatcacttttgaaactattctttcacttccatgaaatttttttgctagtaggcacctttgacaatattttgtatctatacagaatgaaaaatgggcgtttcgaaatagtaggaactgtctcattggatagcattgacggttttcgaataccccacgactgtatgaagattcatgacaaaaatgaaccagaatttctgattacctctcaaaatggacactatatgatttgttcattacacatcacagtgtcatcagtcaccttaaaggttctccgctccgttcaaataggggatagttatgttcaaatatctcatgctgaaagcagtttatactaccttacttgcagagtcatttggaaactgaatctttctaagtctatgtatccagaaaaactgtttatcggaggcaaaatggataaaggtatttattcaacgatgttactccccaaaaatgagtacaaagcgtgcgacaatttgttggttgccagaaatgataaattattgtttcttgaggttgatacattctcaagtagtattgtgtcaaaattcaagctccgcaatcccccattgaagatggcgtacatggaacatatgtcttcttttgttatcatttcagcagaactgacacagagaatctcagtatttaatcttaaaagccgaagagaattgccaatgataattccctcaacagtttttgaatccgaagaaactccgtcctgtttatgccaatgggagctcgagagagaatcaagaaaatacgtccatttaatcgtgggaaccaaaaagggtacgcatgggtcgataaagctgctagccgtttctcaaagcaacgaattaattacagccaccgaaatttactcctgggatgcacaaagtcagatattgagtgttgtaacacttaatgatagctctatcttgttctcatcggggaaaaccctctatttcacatactacgatgagtcgaaacgaaaactttcgacaccgacattggtctattctggaacttccgatattattgcattaagctcaaatgacaacatgatcattgcaacaaccttctctaactcattcaagatattctattattctccaactactcggtcttttagtcaaggtccttgtgataagatgtctcagaacctaatcggcaagtgcttgtatgctcaatatttgagacccgcatctaatagcgaacaggacataacagatgaaggatctatcatagtcagtgataaaatcaactgcaaattatttgaagtgatgaaaactacatcctgggatactactgataattctctattcgaagatcgtcttcctatagtgtcaaggctgtcccaaagttctttgcgctccatgtggtacaaaaaatcccaggaacagaattcagaccaatttctcgctggtggagtaaatggcgagttttacatttatgagagagtgaagaagactcattttaattatctgaggaggcacctggataattgtaaacggctagtactagaaaagtattcgacaggtctgatagattgcccttttgagttttctttgccagcactacttgatcgcaaagaaaaaaatgttattaatggtgattttttaaatcgccaagatccatttgtagattatatcttgagtcggcatactctatagactatcatcattcaatctttcgagtttttaatcttttccagtaaattgcctatcctgggtcccatcatgggttggcctgttcgagttcttttagagaaaatctcttttcttgactccctgctcaattttttttgtttgatttggtcaagttgaattctagttcgttcaattttctctattcttctatgctcctttcgttccttggccatcttaagcctttcctgatatgatagtcggtcaggatgcttgaggttatcattatgtaaagcttctctatgctcctgcctttcttcttgtaccttatcagcatgtgggtcgttcacgatcactccagtattagcagagcttgttgtttcagcctgttcgtcatcctgttgcaagattttgaaatatttttttcgcaaacgtgctctatgaaccagtgatctcttaatatcctcagatttctttttcctcagatctctccaatctgagcttttaaccctgccactcatattcactagtgtaactggttgaataattgattaaatatcaataatctttttcgtttgcctttccattgaaattcgcgcagttattggtcttgaatctttttttttcatcatcctattattattcctagagtgctagttttgtaatcgaccaactgccaaatattgtactccaatcctgtggtttcccgggataaaacttttttatcacaggtgcctcgtgcccatattgcaatgatttcccgacagataaggagacatactctacggcttcgattggagttttgcataagaaccactaataaaactggacttgagtgtgatgcccctgctgtctccatggtgcgttcttttcgaatttggaatttctcagagaagagagcatgtgatactaaacaagatttggctttgtatcgcaattcagtcataccccaaaactctctgtctgctcaagagaaagctcaactaacacagttcatggttattatggatttgcgaacagatgacaatattcacagagtagcaaataaacaacaaatattggacgagctattccatttgatgttgacaagctctcaatactcaaaaaaatatgcaaatttaataaggaactacagtgcctctattgctagaatattctaccgcaatgcggagtatgagaaatgctatgaatgtctaaggctgagcaggaatagtgatataagtccggccatatacgcaggcacccttttaatgcttggaaaagaactggagtttgagtcttttatttgtggaaggagtattcttacccaatgttctattcaccaagttgatcaactaattagaacggtggttcaattttactctaataacaaactcgactgggaaaaatctctcagatattgggcgttgatatgctatcgcatttatggacaccttgaattacttgacaaccaagtttacaggcaaaacttagttgctcttggcacaatattagatggatacttcttgagttgcagggtcacagcaaatgcacaaaaaagaaccaaatacatcaagttagacgaaggtaagttttccaatttaattggtgatcttgatacagttacttttgctcaactattgacgacaataatgaagcactgcgtttatcatggtgatagacccaaaagactggagtttgtcttgaaactttggcgatttaagaaggagagaaagcttcctttggtttcacaagatttaacttcttctatgagagcactagttgagtttaaccaatttgaagatgcatttcgattgcatgaattacatccagaactacacgatgatagtcaatttgacagtcttctaaggtgtcatggctctttgaacgaatggaataaaatgcaaaagcagtttgaggatctttttggtaaaggagaactacctagcatttaccattatgggattgtgatgaatgcccttgggaatcgtggagaaatcaaagctgttgagatgctgtatgaacaactgttaaccagaggcatgattccaaatgctcatattttagcagcattgatgaaatgtcaaatcacttatggtgattttgagggggcgatccaaacttttaacgacaagtttagccagttcaatattcgcaaaaacggctacatttattggcttatcttccaagcttacaaaggtctcggtaatatacatgaaccctttgaaattgttaaacagcttgttaaatcagatcgtatccaaaccctctctcataaagacttacttcccctgatgggaatatgcagaaggcttggggatcacttaaatgcttcctttttgtacttccgattctttccctcaattggaatacagccgaaccttaagatgaccttagaatttattgaaacatgtctcaaagcacgaaaattgggtttagctgattttcttatcaagaaaattttgaagagctttcacaacagcgatcgtttttcaaccaactttcataatagcattataaactttcatttgacctctaaaaactatcagaaggcaatccgccattttaacgagaacatgattcaaaacccaaaaatcaaacctaatggtagaacttttggccttcttatagaaatcctaatactagcaaagcgattcaaacaagtatgcaaactatttgtcactatgcaaaagtgggtagtcccatccgaatatcactatgctaccgctatgaggaccgctttgaaacttggtaacgggaaactggctttgaagtactacaatcagatgctttttaagaaagtttctcctggtctttcgtcgtatgtttatcttatccgtgcgcttataagtaacgttccggttaacaaggatgaagtcctcaacagcaaaacacaatcagtcataacaagtatactagatgatcttattgagcaaaagaagaaagagactctgtctcagcctattaaatatcttcctttgcagttggtggtaccttttattaaaaagttggcctccgtagaaaaaacaggtgaggcaaagacatttgctgaaaagtttataaagatgctgccccctgatagcatttccagttatttattcttagaagctctacttgcaatctatgcagaagaagccaattggcaaatttttgagctaattttcgatctgtatgtcaaaagtttggcgacacagttaaaccgccccgttgaaaaagattcggacttttcagattcgaatgttcgtgcagcttatcttgtggcaaataggttgtctactgtgtgggccgttaagctgaggcatatgatacaggttaagaactacaaatctatcattcctctcttacgtcatttagaatcaatcggcttcaagctttcgaactatgccatgaatgaaacagctagatcgcttttgatacatcacaccactttggaagatgccttagagtttattgaaggtcgtttgatcaaaggttatctttttctgaaatctaagagaaaattggtaagagaaaaacaatccgagttggacaggtcagctctccaaactatgttgcgcctcaggccgcatacttcctattacttgagcggagcaacatactttcagacactgcgtgcgatagagaaatttatatctcagcgcgttgaaggtaaggagcgtgctcaagttctcatgaggtttaaacatttatatcccatgactatggcccgatatgatgataatatatcgcaacttgacgaatgggaacggataacgcaggagaacaggtcgcttgatttcaaaatcaaaaagaaaaaccctgcagttagaccagaacgattggtaccacatgtgttgcagacaaagaagaatactgcaaacgatgatggggagcctgtatcacctgtacatatagaagctagacacaattaatagacctggatgcatcgcaatgctcttatgttgcaggataggccacctcaatctctcccttagtttgtccaaagaatagaaagccgacatagggctgtaagttccatttcagtttaaccgtagcattgcggccttgaaaggagtccgacacgtcccaaactgagtattttcccctctgcttattgacatgcactcttgcgtactttttctcagtaattatgctatcccaataggtcaccttcgcaccatcatcggcaacagaggtagggtactctgctaccaattgtacaaacagttgtttagtattccaattgaataatggagccagatccatatcaagatcaaataaaatcttggagttttctttaggtctaccaccgactgaaccaaacgatctgctatactttaaatttgttgatattacaacattgcttaattgggcaggaatactggacgtttcatccaagaacatactaataattgagacaactgttgtaacaatacataatagaatggaaaccgttaaataaaaattgctcaaactctgtatccgttggataatgttgaacatgcctggcgatcgtgatatgatgataccttgaattttgttcataccgaacaatcgtagaaaaaaactatgaatcacaaagaatataggttgctacacgaccatcttgataacctacaaacgcgtatcgtgttaatgcacgcttctctgaactgcgaaggatcattttgctctgaccatcacttctctccactagtgcattattacatccattttgagtttttgacaacttgatgactctaccctttaaatcaggaagatcaatcgtttgatgattggaggagcttttgaagttaggaataacttttggtggaattcttctcaatttagtccagggaatgaaaacaccttttagagcctcatccacagcagctgacgaatcttcatcatatctgtaaatccttgaaaacccatcccaagtagtcacggagacaaggcaaatgctgttattaatagttacatctaggcttgaaatacctttatgtttgatcttagagattgcaacagtctttccagtttgaaggctattgacgacaattctatcgcttgcagaacaggtaaagaccctatccaaatttgacacaatccctaatatagggtgtgtgagatgagaactgtctatccagacaacttgagtatgtctctcttgcaactgaatacaagcaacaattccactctcgtaacctacagctaactggaaatctcccgtccaagtgatttgcatgatagcaccaaattttcggttttcgtcggtttcatttgaacgctgattttgctgtaagatttgacatatatctacgttcgaatgcaagcgctctaaccggtggttactgacaacataaatatcaaaactttccgatgacaaagatgctggagttgcaatcatttcagctcgagtagcaacattacaaaaattcaaagcattgacaggaatttcatatacatccggattccgagcagtgtctcgagttttgtgtagtaccttgcatagattccaatccatgctactaaagctactcaccctaaacaagtcccaaatacgcacacagttatcccttccatgggtcaatagcttaccaaaagtgttacgatgtaattgaggaacatctgcgtcccagtgtatacccatctgttgtacggttactatggttgattcatgagctctccatgtccctagtggacgtttcgttcccaagtcccaccatacgacccatccgttctcatcagcagacactaaagacgctagaaggagaggttcaccattaacgacaaaaggggagggtaaatagaagggctctaacgcagaaaccggagatttatgaaatctcagcattgcatccgattcaatgccatgtgaagtatgtgtgtgcatacgaatcactcgcgttattgaattttttgatgtagaatttgtaaaagtagtttacgacctttgttggaaaggatcttctagtttcgctagaagcactctttcaaatcgctacatacgaaacgcagaacattaaacatagcagaccagtgctaccaaacactagcattaaaggcaatactgaaatggtgggaagcattactcgaactgaccaataacaaaaactacctactgatactgttaaatatcggtatgattgctccttgagaccctggaggtatatgattggtgctattgaagttgacaaagcagtttgaaacatccagagggataacggaatcgcacttttcagtgaattgctttccaaccgatcttgtaaatgaattgcgcaagccattaatgaggcataacacaaaactataacacttcccaggtaagtcaaagctgcccttgaagtggtgtctacgaacacactgggtagcatcgagaatagaggtatcacaattgataatacaatattcagcaacactgttctagccgataatggtgtaacgaagtactcaaataatttgggcgcttgatagaaaatgatatagttgtttgagattgaggcccagcatagaataataacagatctaatgttactcttgaagtgaggacattcttctctgcccttgtgggaaaacgatgatgattcgtacgatgattttaatttagattttgaagaggaagagagaaaacgacacgataataccgatgcaagaataataaagaaaattgaaattgtgagcaggattgagtcctttttcttggagaaagagaatggcaggtacaacaacaaatttttaccaaaaaaatagacacagatcaacacaccttttcttttccgtgttgcaatataaagtgggacggccaatgaaagtatgacaagagataccccaccgagaatatcagcaacaacatgaacaacaatggtagtagacctaaaaaaccaccaaatcagcaagccaataaagtaggtacacaaactgatctgtatcaaacaaaattccttaagtggtgacggcgctactactagtcgcaacactaaaaatgacaaaacgtgagctatcaaaactgtactaacaaacacagttgaactgctgctactgctaccgctgttgctctcaaaataaccttggttgttagaagactcataatttggtatagaaccaagtcctacaacaaacccacagccgataacaacaacgctagacaaacaagtctttcgtatggttttcttctccagtaaagtcatctctcttttttttcttctttgaagtttgctatctgtagtatagtttcgtaagtttggtatttggtaaacctgtgtgtgtgtcctcaacaaagtacaaactctctgtagtcaatcttgttaatcaatctgtaatagtaataatataattctcaatcaatcaacactcaactaatttgacttacttaaaccaattaattaatgtaatgattcaaaaacaccgaaggtagtagtagataggaggcgcctatttgatccaaaataaaactactctctctcttacacacgaatgtgctggatattgaacgtagtatgtagaggttggttggttggttaagtaattaggtttaggcaattggtcagcaaacccagctttcacagagatgagataaatgtctccaccacacacaaaaaaagaagtaaaaccactacgtcgttacaaacactgactgaacactgatgcttaaagaacgtacaaaaacaagcaaaacgttcaggtgctagcgccgtgcgtgcgcacaaggagcattttttttacccttttttctgctctcccatgttgttatgctgttattatatgctagctatgctggtcgattatcatcgcgcgcccacaagatcaatttctccccgaatagatgtttgtttgttgtaagtaaatgctcttatataatatgcaggacacatacatactattcatcttgttgttgtgtttcaaccatttgtcttagtctttctcgcccatcaactttcaattagttcttccgccgccgccatccgatccgtcgtatacttctacagtcatttcgacttctcgattataaaaaacagttagttagtagtgcaggaggaaacaagttttttctacattttttacttcttctcgtttcccacccactcgtccaagctcccgacagccagccagccaaacaaacacaatccatcaatcctccatgactcagataaatagagagtcaaatgacgatagcacaatgcaatatgagaggatccctcccgcaaaaggtgtattccccttttggtatggaggtgccgcatctatgtttgcatgtttattcactcatcctttagatcttgccaaggttagactacaaacagctagtcaacctggacaaaatctactaacaatcgccatccgtatcataagctcagaaggcatacttggtgcctatagtggactcagtgcctctcttttacgtcaagctacatactctaccacccgctttggtatatatgaagctcttaaagattacttaacaaaggccaataataatcaagatttgagtacagccattctgttaccttgctcaatgcttgctggcggtataggaggtctggtgggaaatccatctgatgtagttaacatacgaatgcagaatgattcgagtctgcccaaacccgcaagacgaaactatcgcaatgcgcttcatggtctggcgagaatggctaaagaagaagggcttggctcttggtttcgagggttgttaccaaatcttactcgaggtgtattgatgactgcttctcaagtggtttcttacgatgtagctaagaagtttctagtaaaaaagctttcctttgatgaaactacgagagctacgcatttttcggcatccttaatggcgggattagttgccacgacggtgtgttctcctgctgatgtagtgaagacacggattatgaattcggcagaaaaacatcaatcaattataaccgtgttaaccactgccatgagaaaagagggcccaggctttctttttcgcggatggtttccatcctttattcgcctgggtcctcatacaattttgacttttgtagctttggaacaattgagaacatggcggattgccatgtagactatcacttggctagtcggttccatttctgatagtaatagatataaatataaattagctatttattgattgacacttattgctaaaccattgatgatgttcctggtttacttacatttgacatttagtatttgacgctacaggccttgaaggcagctaaacgttgttctcttcagcgacaaagatatcctgcgtggttatgcctgtaagaggagagtggaattgttgagaatatactcgtttgcacaagggttttaaaatgttcaggtttacggttctcctgcgttttgggctcgaggagaatctgaaggtacattgcgatgtagttttttcagtcggaacagctttaaatgctagctggtcaatctttgatgttaccaaagaagtgaacttgctctcctcgatttgcaggtactcgtagtatttatcaaagcaaccaaatctatgtttccacagataagaagcaatttttgagttctcttcaaaggatagatcaggataatatctttgaatgactttggagaagatacttttggaaataataaacttatttcttggtcgatgtgtcgatagattgaatttcttcccagacaatcctttgcctgctgtcgttttgtagcttttatcagaaacacaagtcatggcaaaagcgacagaatcaaaggatgacgataggaacgtcgtaactgtcatacttctgtcctttctacctactagtgtcgagatgaagttgaaaatgtggaaatatattaaacctattattttagagaagatagtgattgtaatccttaactgcctcaaagtaaattctatccatcagacctgtgaatgagacacttatgtaccgcagcgtagcgacatgcatggcaaaatcataaaacggcatctagagaggatgacaggtaatacgcccagattttcgatttgtggttatagtacttcaagttcgatcagactttgtgctgcgtattacagaattagttctatcacaccgttaaccttggattttgttaccgaatcacacagaattattcgtttctccttcaaataaatttacaggtgaggatacagaactagggttagatattacttgtgtttcagattatgtttcatccatttaaattatgcaggttgagcacaaaatgcgcaataatgatccaaagatcccagagtttttttagcctattcgggaaaacaagtttcgagcaacgttatcagttccagaatatcgtgttagaaactagctttaaaggcattatctgcatacggaaagctaaaactaaatgaaggttacagataattacacgcacatctgacccaagtagcagtttgtctcaaggtacaaatgcaattctaataagcacgagattacaacgtccacaaattattactgatacatataaatggtaatctacagctagttaaaagaaaaagcgtaaactctcattctacgtccatcattaaggtcgttgctatgtccggaaacacttttagagaaattacagccgcatgcctattgtccatgatactttctaccgatgattacacaaagccagcaactagttgccacatgcaccagttaacagccccagacttatccgattattcacttctggatgcattatttgtcacatgtgacagagcactagagtaccaagctctcacttatcgactgcaagcatcgatggaagatgcgatgaaaattatagagtctgccagatatcagacaaaagatttaccaacgttggataatatcttcaaaactttttacaaaactctgttggatacaattgaaagtatagaagcaacaggcacttccacgctgctttcagatttcactcatcaaatttcattttttaatattgacccgtcagtcatctcgttatccgatgaaacaaaagaatgtgcctactccttttttagtgatagtttacatcatcatccagtgaagcgtacaaggaaaaccatttcgaaagaggtaaaaaaaatcctggaagaagcattcaaagcgaaggcagcaccaaatactaaggaaagattactgattgcacaaaggtgcgctttgacaccattgcaagtccgtatgtggttcaccaacaagagaacaagaaacaaaattaagcaacgacttcaagctcagtcccatccataacgtaagctattcaactcagttactcttcgtccgcatggtatccaaagcgtcgaatttccccaagacgtcttcgcgcattctgtagagcagtttccaactttaaaatttcaacctgttgctccatctgcaccgtcttgttttcgtgcgctgataacttactgtagtcaatttctagttcctctttatctttttgtgagagtatttcctggacttgacgaaccaaagacctgcaagcagaggtcaccgatttgctagcaagttctaatttgtcttgtgtcttactcatgaaactagctttgactctagatgccgcaaccaattgagctgtagatgcagccacgtcattacaggcaacgatcagctgctctggtgaacttgttgaagataaaacaccatcagcaatttggatcaaagagttggttgagtatgctaccgatttggaggcagagataagcccttcagtccacttgttgtgtttcttgtaaaaagacgtgcggctgcttgaaccgcggccatgattgacaatttcattctggcaatcagtagcagtcttaattaaaagaatgatagctttagtcactgcaatagcagctgatagaatagaattgttaatcttcatatcgatggttgaaatatcttgtttcgcattcgttaataaatccgttaaatgatcagaggctttagcaattgtttctgcagcatgtgccatctctctgtcaactagttctccgacattgtcgttgacattgatgttaacttgagacgatattaatttctctactaaggaagaaagggtctgcaattcctgctggatgtccacatttccctcaatagccttatctgtcttttcttggtcgctgagcccctttaatgatgaagaatacaatgaaacgataaaagactcagactcttcggctacatcacgggccgaattaagaagtgcttccgcttcctggtcactcgaagccaatcttacgactcccttacagttaagtaatagatcgacaatggatgttgtaaactcggttattgtctgaataaccgatacatgatccccgttagggccatctgcgatgaaaccattaaaacttgaagtgaattcagtggccaaatttgatgatttctcgataatagaagacaagtactccggggatgaattctgatttcctgcttgcattggagaatccagctcgaaaagaccatcttgaattctttgcactccacttgttaggatcgcatcgataacttccgttagtttatcaatatgctccagtagaatagcgtcaatttgttcgtctatagcagaattttgaatgctttgttgccctgtcaactctttaattgttgcctccattgtttggtgtgcaattgctaactcgtcatccttttcttgtaactgcgcttccagtgctttgagacgttcatttgcagattctgacaaagaagaagcttgcagttgattttgcagttcctctatttccttgttatgctgactcaagaaagatttgagctccgaagagtgtaatttctcgatgtcggccagcttagtttcctgttcccgaagccgagcctctagcctttcagtttcactattcttgtcactctttgatcgttcaagatctagcctggcacgatctctttcacggattaaatctgccaactctatgttcttagccttgagatctctctcaattttttctctcttatcgattgcttctcgggcagacgaagcttttaactgtgccgttttgaattttgaaagaagattcaggtgctcttctctcaattgggagtaaagctttgctaaagaatcatatttggatttccattgggcagcctgctcctgtatgttgcctaatagctcctccttcgcccccagttgttgttgtgcattctgcgtagtgctagaaagctctgtctcaagggcctttaccctctcatcatactgccgcagcattaattgatctctgtcaaactgtcctcttaaaatcagtaaatcacgttctagctcaccaacacgtccttgaacttgtctctgaagttggtcactttccagctgctgttgtgcatacaactgttgttgctcttgaagctccttttgtttctcccaatattctagctgctgttgctgttgatgctgttgctcgaggagctgttgctgacgttcctgctccaagagttgctgttcttgttcgtattgctgttttagggcatttgactgagcccaaagatccgtgcctgcagtcggctgtgaatgaatcacctcggttggcgtaccaaattcttcagatggtgccttactagaaacctgaagagatggttcttccgctaggattcgaggtttcagctcgtcagtttcgtcccaattgaatagatcgggagcttcaaacggcagtttggggatgttcaccaaactggtgagatacttaacgtacgaacattcggcataaaagtcgtacaagtcagaatactggcttatgaaacgttcaatcagaggttgcaatgcttcatcgtcgtgacctaaagagtgacacattccccttaacattgaggtaataaacttaaatattccgtagctttcagcaataaggggcactaaagcactgatttttaattcagaatgactagagctgtcgatggaagcaaacagaagtcgctgaaggtcgtttatcgaatcttgcagtaccattaaatccataatagcttcataaccttcattaggatcacttacagtcttcagtgatacatactcctcgtactcaaacgtaccgttgaatcctttgtgactattgtggaaatcaatctttcgaatgagatatctatcgtactcacgaatcaatcggccatacctcttcattccgtcaccgggaaacacatgcccaagactttgaatccagtctctattcttaattccctctttgatcgcagatgggtgtccctcctgaagtactttatgaatcgtgatcaatgatttgaaaagcggtatctcgtcattctgaataggaagtaaccgcaatccgttgtaaaacgctttactagagcgatggtcccaggtaaacacaatacacgccctaacatgttttctttttggagcagcttcttcggtggaacaggcctccttgatgctaactttgagatctgcctcttgtcggctcattatctagtcgaaattttcggtggcgggcgtttttttttttaccgatagaacccccctggaaggtgacaatcctcttgagcgtcaggcggaacacaagaagtcgtgattcctcttcccatttatttagattccgactccctcccctcactccctcacatttttgatgtcctcatctccttctctcgaataacattcaatctactgtcaaagtcacacaaaattaccttcacctggtctgcttctacaagtgtacctgtcatctcccactacccttcccttcccgtcctccccttctgcctactatttccctgaaatcccataattattctttcgcgaattcgagtagttttttatttgttttttgcaacaatttttttgccttcctgcaacgcaactacttcattctcttttttctttttcggactatatttgttctctgataatcgacatacttgtccactttttatggcatcaatagagaacctaaagtcttttgatccgttcgccgatacaggcgatgatgatacacagcccactaactacattcatatccgtatccaacagagaaatggtagaaagacattaaccaccgttcagggcttaccagaagaatatgacctaaagaagatcctcaaggttttgaagaaagattttgcttgtaatgggaatattgtaaaagatgatgaacttggtcaggtcatccagctgcaaggagatcagagagtgaaagtcatggagtttttgacctctcagctagctcttcaaaagaagaacatcaaaattcatggattctgattctgttaggaccaatttgtatgctcttacaaggatcactctattttagttttgctctatgtctgtgggaggtaacttgtgttcacagagtctactactttgctggcaatgatggcttgtataggtactttccggtttttctttttctgacatattcaaggcttcaagtttgctctgcggactactcactaaataagaatccactcgaataatacataccataccatctttgagatttcttcggttttgaatttaagattgggaaatttacgattcacagttgtgtgatctgtttctttgtttgtctctctctctcctttgtagctttttgaaattcaagcaatggatcgttgccgccgattgttttattcacaatgctttcagaggcattaacctcagggtaaattttagtttcaccatcttgcttgggtataaactgtctcttggtattttgtgatttttgcactcctttaccctttcttcgttttcccaacagaaattcttcatgttcttttgcattctgcttcacgacatttttgttaactccattgcgactgtaatcatccgtcttatagttttgttcgttgtacatccaatcaatgcgcatctctacttgagaaaacttctctggttgacctggatgccgccagcttaaacttgcacttttttctttctctttgcctatctcctccaagcgctgttggattttttggtgttcttcaagtgcgtgctgctctcttttccaaaccttttcttggttcttcagaagctttggattccaagacttcttcagatttaagtcaccaaccatagttggtttaaatttgaatacaaatggatacaaagagagattttctcattcgcatagacagatagagagatacacgaaaatctcttcactgatactatactgcattcattctcaacgtgaaataaggaggacatagatagaataccatgaagcttgcatttgtagtgagcaactgtttagcctgtagaaagaaagaaaacactatcaagccagtgaggctcatacttggtcacaagctaccaattgctacggtccctgaatgaagttctgattgaaagtcactactgagatccttctcttaaacactaaaaaaaaattaccactggctaaccccaagctaatagccgctattgaaatatagtgatcggctggatgagaaattagctcctgtttgactgcataaactaaatacctactcaatgttgcccctctttttattgtacatttctggagaattttataacccattgacccttaaaggttagcgagcaagatccatagttctagaattctatggcctctctggcatctattctatgactactataagaagcattagcttaaatcattttcacaaattttcaaaaattggaaatttgcaagcagttctagctggcatcttcaaataatctgctgtatcagtaaattcgacatatcggaaagatctcaatacgtcttcttcggaaatagaaacatcgatcaccccatatggtccaccatctgtagtgtctcaagcaacatgtaccaaaactgtgattaaagtgttgctgatgccagtttgcgtatcattcagcgatggccaaacgtgtacgtactcaatttgaattgttaggattttcttggtcccgtttattccacactgcaagtccaacaactaaagctattaaggaacgtactgcctgtctcccgctataggcgtatgaaccaaaaaatctagaatatggtgagagctcctattgtgcaatcaatattggcgagataaatgagcgaagtcactatcggtgtcggaatagaagaaaatagtgtcacttcttgattgactattacttttgaactccgctgcgctgtagcattttttgctctagtggagagtcgcacaatacatttttgctgacttagatcggttatcgtgcatcgtacagttgtaggatctatattgcagttttaatttactgatcatgaccctattatgtcttttaaaccccgctccccgctgctgattaacttggtaatcaactcactatttcattcatgtcaacagccccgaaaacgataattaatagacaaccccaatcatatttagtgagttttcggattaaagcttgttcgcgttccggttgatgatggtttcaagaaaatgctgagctcgctcttatactgggtcccttgaaatgatatgcatatgttgggaatacgctaatgtactttgacagatattgcttctccttgtagcaaattgacagtttcgtttgcaactgtaacacttggtgatcgatatttggataaacacaattactattttggagttacaaccagaattcgtcttaatgtttcgcatccttgttcaaagactaaaacttcttcgatttcgaatttgtcttaagtattgactagtcgggctcaaagagcaacactagctggaaacggctcaggatcactttcgttttttttctagaaaatgaggcaattgtaggactgggtctctttatctgcaatttgtgtaagctggtttactgttctcaacaaaatagaagtgaaccgtccgtgatgtaaaatgagactactccgttgaatcgcaacaagtattatatcctagcttaaggtgattcttaactttggagcaaaaatatcgtgtaacaacgccggctcagtcaatcttctttgaattaacactgcacctctatcttgaacactatctacatgagtgtgcaaccagaaagaatgcaaagattaattttcttacccacaatgtggtccgatccacaattctagtgaattcctaacatgtttagtaccaacgtttgaacaacagatacatcacattgaaaaaaaggattgagaataataatcaaattttcagcattatatagtaccacgaaactaaatcgctttggaaggagaaacattttcaagctgttaaactggatttatccaaaatagttagtttgcacaagtttaaaaggaggtgtctaacaggtggggaaaaatcagttaattgagtttttaatgatccaagagctcggtaggtccagaaaacttatgaaacgaaaatttctcgttgacaaaagaatcaagtagttgcaaaatcactgtttacaattggacatttcgaatgtactatgaggcgatcgatcttccttgattgaatagtccaatacggaaaatgaaatcgtgtcgatttattacttaatcggtcgaggtatgttcgaacggtttcaatgaaagcaggagaagaaggttactctccaagaccacattgaccatccgagcccgccaggccctacttgacagccaggctactaaaactgaatgtaacaaggaaaagagagtttactacttttcgatctcctaaagctaaggagactggatggttttggttgtacctgcaggacaggggattcggtctgagttgaaaggccaaattgagattctgtgacaaacaaaaagagctggtcctatggaattccagattcttctatcttgcataaatacatgcttatttaggtaactcattttgcccaaataggaaatattggagtatcctttctataacagaattgtgtttaattcttatgtcatcctacgggcatcgctctatatcattcaccacgtacgttccaatgatagcgtaatagcgtgcgaagaaaagggaatagtaagccacttgtagaaaagtgttggctgatcactactcaaaatcagctccataccctgagttaatcagttcacgttgctcaagcgtctaaaaatagattgctattgcctgcgaattctcttaggcctggaacgttctactgggctcgcggaccgtgtttattcctgattctggaggtaaacggtggcttttgcagaaaacgcgcaggcagtgttaattgcaaattttttcttccgtcgtatttctttttcctgctggtgaaccttgattatttcccatataaataagggttgaagctccttgattttttttcttttcttgtatccaaaaaatcacactttgagcagtcaatatttataatattagccgaaatgcaattcaagtctatcgttttaactctagctgccgttaccgttgctcaagctaacaacctatcaaacgagagtaatggtactaatcactccaaccatacttcttccgtgccaactggagctgccgttcgtgcctctggtatgggagctggcttgttgggagctggtgttgtagccggtgttgctctattgatttaagctgtttgtccttatacatcattccaaggttagaaaaggccggaaaacagacatttttatttcatagaatattgcagtaggatatatccgctacactcgcttatcagcccattttaatttaatattttagtttaattttttaactgatcagttagccttctttcagcaagggctgaaagatgtcgtgcgtaaactcaaatagttacttactttagcaatgatcatttgtttgctcttgttgtagccaagtttctcggcagacaaaagccgctcgttgaagtccattcggaaagtcaaaggtcatcgaaagtatttcgaaggggctgaatctcgaagggggctgaatctgcagggactttacgtgtcttatcgatcaaaagattaattctaaaacaggcaagaaatgcgcgaattaatcttacaactatagttgctgctgctttttagagcggtcaacgtttcttaccaggttgtttaatttattgattattcaattgcaaacgtcgtctaattcattagaaacgaaagctatgcattcaagagactggtttttagcagtcattgggtttttcctgccccctttagctgtttttattaagagaggttttctttcgggagattgtgagttgcctttttgttttgacctgtcgatcgaacactaaccaatattagtttggataaatgtagcactctgtattctgggatatcttccaggtctacttcattcatggtacatcatctcgtgctacccatacgaaagcaaatcttcttacagaggggtgactattcctggacgagagagccaatcatacggagctattcagtagtatcactacaaatggaaaatctgtttcactagcagcggagattaatttggggcctttcccattccctcccgtaatttttttatactatttcctcagtggattgatcagtttcttctcatttaaatcgtaatggtgggtttttagtttgttctgcgtatcctaatttatacttatgttgaataactttaaaatattttttcacttcatttcatgctcttgacgtccctttcttatcgattaatcgatgaacttgtcaagctctggtcatgcgcgatgatgttaccatgaagaaaaaaaaacaagcaaaacaactgacaccggcaccaaagtcatatacaaaaataatatcaatgaacttgattaacgaagtgattgaaagaaatttgaattttgaatcaactacggaggaacttcgtaatgctgagaatgtaccagtggtttcgcttgatgggtttcctgttgctactaaaagaaggccttcaaaatggagcaataggctccattcaaagaaaccacaaacatttcccactgacgagttgaaatcgttgtataaaaagacagactatgtctcaaagccagatagaatactccaccttggtgccgatactcctgggttgcaaagtccgtctcaaggaactgcggggcagtccaaggatctaagtaagtatatcagtcgagagtcgttaccattctcacaacgcacgtcttcagaaaatgagaaaaacagtgactatatcaatccacaaacaaaatcgcttcaattcgttgatgaatcttgttgtactgaaaatattgagggctacggaacttggataggtggaacagtaattgaaccacctagcgtatcgtccagcaaaactgaaggtatcaagtcggctagtagcacagaagcatacagtaatggggaggatgcgtccactaaaaagtgcaaattgagctgtaaaactgagtttcaacaatcacttcagtgggatgatgtagagtatttcaatgagctgtatcccaaatgcagcgaatcaactattgaaacggaaatacccaataatacaaccattaacaccaaagaaaaagaatatattgaacttgacctaaacgatccagaattcaacgagaagctacatcagaagtattttccagatcttccagctcatccagaacagttggcatggatgagccctgttaccaatgaaacagaagaaggggatgatgtagtctatgatgatgttaaagacatcagatttgattttaaaggtgagatgatccctacgagtaaagttttgtctattccaacagcagaaggcttgcatcatcattctcgtaatccgggaatggcaggctacacattgcacgagcttgcaagttatgcttgctcaacgtttcctagtcaaaaatgcatcgctattcaaactttgggaaggattttgtacaagttaggaaagcatagttatcctatttccgtagatgaaatcgaggcccgcgatagtggccggtatttgcttgcttcctttgaagacacgatctggaaactgatagaggaatttcatataattgaaattctgataaagtcatccaatgagagggaaacttctaatctgagcataaggagctatgcagtcgaggctctctggttatggagagctggagaaggtgacaagcgctctcttacttcccaacatggtagtaacaattagcggtgtatctacaattattacgtaattgttttttgtttttttttattggactacatgaaagattcagaatttgcaaaaattcattgtacagcgcaaacttaagttggctaattcaggaagctccttccaaaaatattagaaaatgtgtctttgtgcttagagtaatttgtcgtaatttatcatttcgatgcaggttataccagaatgaaatagtcctacccaccatttttttcaatactttagttcatctctatgtcgtcttgacccgatgttgaactgaacaatcacctgcaacagctaattgctgccatgtgtgtaccatcttgagtatcatatacttctgtatatctcaatatatttcattcgtgctcagcatttgttggaccccgaaactgaataaatttgtaaacaatcaataattatagcggcgctctgatgtcgacccatcttgcgtgactttgaactggttggtggagggggtgagcattcatgcagaagtatactctgtagcgcagatagattgatgttaaagtgatgaagctttttgaactgaaggtgaggtaaagtggtcaacagatgaacgctacacacgcacagtcctactgaccgcaggttttgatcaacttatattgctaaaactataaatgttgtagccgtatatgataaaacagcactcgagaatgattattttatggtgtatgtctccgttgcaatacctgagctaagctttcttgcgtagtttttattatgcgctgaatgttctatctggttcatactgattattgttatgaccgacatgtttgcttatctatgtttgatatattcattaggatatgaagtcagtgaaatcttgtcgacaaaagttctcagattcagctttgctggtctaaaaaccacagcctttgccttgacggttatttacgatcatctttcataaaaagcaacaaatcaagggtgatctacatcttatgactcttacgttataagagttaattttgcctccaacttaatgaaaaagttgacaagaatgagtataaaatgtactgatgacttagtaaagtatgaaacgagagttaaactagaagttcaaattatttagtagaatgatataacaaattgtagcaaaagctttacaagtaacagtaatcatacgaggcctgtgtacgatgatgaaagcctgaaatcttttctatgaatctatcgtgaattactcagttttagtccaaaaaaaaagaagatttatgatttcaaaatcagggaacaaaggcagactatactctgcatggattaagcaagaagagaccaaggacttgttgttgttggatgttatccctctttctttgggtgttgccatgcaaggtaacgtctttgccccagttgttccatatataactagcactgattcaatacccgaattataagttttgaaagctccagaaaatactgatgtaagattttattgtctgactgtagattgttcaagtatgacaccctctcctattgaagttagatacaaaaggtcgaatgaagtacattgaaaaatacctgctttatatttaactcttaacctacggtaacggccctatgaggatcgaaaaccccccgtagaaataaatagctgcgaatttcaatcagataaagaaatgacctatcacaatctcctacaaacttgtgttggtacagagcaggcttgtttgccacatagttttcttcacaatgttgcaaatgaggcctatcataccctcttagcatcgttgaaacttgcacaaacgaacgtccaacttaatcttttgtactctgaaaagtgggaaatatgttataatacccagtgtgactgtaacatgttggaacaagatcaagattgaagagagcactgaattcaaaacaaacatcaagatagtgagaatttagttgactaatcctgttaagctgaaaaaagattgcctttgctgataaaaagagaagctggagcagtccttataataatcacaatagaagcttgtcatctccggccattctatgcacccagcttgtcatccttgtcgacattcaaattgcctaaattatctagctttcccaggtacgctctagataaaactgccggtaagttgttgcttgtctcgaccaagccatctccatgctcaatcagcctgctttgcaaagttaaagtgtactctctcaaagtcactatttcattcttgagactttgtatgatctctcggtagtggtccacaagttgtgcttttttctccaactctcgaaatcgctcccccctcttcctgcgaaatgcctgctgtgcttttctgttttgctcagcacgcttcgtattaagtactttcttctttgaagtcggagatgtggaagtaatgaaagatggaagcgatttgggatcggcagagttctctttcatggcaacaactgaacgggcaattcccgcagcagctccaacatttttcagcatcgctatggcttcgctctggctagagccgttctcacactcattatgagcaacagaggcagcggctagatctctaacatttgaatgagacccgttcgccccttttgtagtaatgcctttgaattctgactttaaatggtctctttttgtagccatgaatcagcaatattcaaaggtaactcagcaggagacttatgtaatggatgacaaagcaactgaaaatctagtcaattcatctcatagcaagataatcgcgggagtgggaataatcgcacaacaattctactgataaatgactcgtaggaaaaatccaactttaatttcccctcttactatcatactagaagattcagtaaggctgctactatccatgcacgttgttctcgcttccattgagcaatgaaattgaactatctctaaatctgaaactgtcactctctgttgtgtactactcgattatataatgttaggatgtcacctttctcaaaaccaagatacttcggatctgaatttttttcgtcttaacaatccagtctacttcactgacgtcaaggtagccactgcagtttagagaattcaccatatcaaaatccaatacagaaatcgaattgcgaagggtacctgcaaataaagttactacataaggtattttttcgttgagttgtttttgcattttgagtgacattttctagtgatttgtttctgcccttccatattcaaatttagtatcacttccgatgatcccaaatttatcatctggcatggtaagctttggtgaccaagacttggaggttggcacttcaacgttccatgatgctccaccaaactcacacattgttagtggtggtctttccacccagatgtcatccttccagtttatgaacatggatgtaaaaaagcaacacaatgacagtaatagcgaagtaagtgggcctagttcaaatcgagaaagagcaactactggcagtgtttggcacccgattcccgcacccaatacccctactcgcaacgatgtttccaaccccagttttagtcctatggctcaagccccttcggcttcaactacacaacagtctcagccacctttggttcctggctataaccgacggaatactactggtggtcctgctgtccccaaaccacaaagttctcaaagctctgtggcccatcgcagattccttacaaactttgttacaaaatgacaatggagttttatggggagctaatggaaagaccacaccagtaaaagaagatcgatcaacaagacaaagtggtcaagcaattttttttgggccagaatttgggtccagtacttctgaatttttagatcccctggttaccgctggttcaccttggaacgatagtctttcaaactttgcaaccagctgtaacgtaatgacccctagtattatgtcccgtacctctaggttctttccgtcacccgtatctgatcagcgtaaggatttctttcaaggggggctgtctggaacagctgctggggtgtttactgatcctttagtttgtcctgccacttcgtcagttcgatcactatctgatgaagtgaatttggacctaaatctaggaataattgacacagaagaacccttcaaagcgcaacatgttatcgataagttaagcaggtttagcataacctctgtatcggaataccttttgaacgagcacagcgatatacgcttagtcacacaatctcaaaatgaatgggaggatgaacaagaagagtatgatgatgattgggaaacagtttctggaagcttagagttagcagtagctgaattttctaacatgattgtaagcttaccacctcgtggtttgactgtatctgcttcttcatctgtcagttctttatcatcctctagcaattcggattcatgtgccgaggcgggattagagagtgttgatgttacttcttacatcaagaagataatcacccggcaacaagagacccatgttacatatattgcctctttatcccacagtgccaaaccacaatttgaaaaactaatccagcaggtgtttcgaaattatggagacattctgcgaattgaggatgagccctccactaataatgacttcgttaagtttaaagtctttactagacttaacaatgggaaaggtccttacaaaattttcaagttcatcaatgagagaactcagcgagaggaaaaaatgcttttcttttttgaaagtaacagtggaggaactcaaaattccggctatggggttagtgctggatcaaattctagcacgggttcaactccttccaagaatgatgtaaatacctaccctgaaggcttctcgtccacatttcacaagcgaggaattaataactttatgtttgtacgggaactacaaagcaagatgattgttaataaatccgctaaaacgaatagcgaatatggagagtttcgaatttcgttgcctgtccaccgtattttgggagggacgaaattcacaaagaagtctttcattgtcaatatcgacctcagggaatatgagagcaagagttacaataatgacaaagcaaagcattttaaaagtaagtttagtggccgctaaaggtagatctatataggacaaagatatcgtatttgttgccggtcaacgtatttcaacaattcagtatgatggagagattttcgaaagtaaatgagtcgttacgactgtgctaagttttaaaacaaatcacagtattgtgttgggacatttcagcgcgataatggtttcgcggttttttgatttttagctactgttgtcttgactttctctcctgaattcacggagatgaattccagagaatgcctttctatcttcctgaagatgatgccgtggctaaacttgaagtatttggaaacggtactgctttaaaccaaagttgtaatatttttgctattccaaatggctacttacagatttctccttctaaggagcaattaggtctcactcagccttgcttttacctcaacaactgcgcagattatctaacatccgaagtggcttactatccagtttaccaatttctctctgccaataattttctatccatcgcaaaagacggtattggagttggcaatgttgctttgagctacgtcattagtagtgtgacagtggccgcttggatgcttgtactcgttcttattttgagtcgtaaccataaaccatttacctgcaagttttgtgccctcgtttatggtatcacgatgacggttgttttggcccgaagtaccgcagtttttcgaaaacaacatggccttggtatccaagatacacgcaagttttacaagacggtactgggaggattgagttataatatcactatgatcttaagtgaattttttacatggattgcctgggtagatatactgcgaaggatttatcccactcattttcgccgccccgtttactatagtgggactgttattgtcggtatatggcttttaatctccagtctagatcgtttctattacagctcgagacatgaaacaaggaatcaatcctttatttccattgtctcggctgtcttgagtggagttatttattccatattttcaataatgatgctagtctatctatttcatttcaagggtcatataattgcccgaaacaagtccaagttggcagctcaattatgtttgaacgtggctgatattggcattaccgtgacgttctttattatgtatcgaacctcgacaaatcttgacgcctggtcgtcatttgtctatacatttacccaagtgctctcagtagctctgatatgggagttatgctatgatattgaacgtcttgaacgtacagatgagcacatggctgtgattgggcgtcaggtagatgattcccttccagaaggtgacattactgcaactcaagatctacctaaggctcacaaattccggccctgggtttcattcttggatcgattctttcctctcaaagagcaccaccgcataatgatagagtacgaacagcaagtgcaacactcaggtacagctacttacccccctagttcctcatctcaatttgaactacaagacctcggccactgtttagacgacaatagtcaagtccagagccaagtggccagtgatcaggtgatagcggaatttcccgaggctgcatcgtactctcattcacaaggtgggtcttatactcaattcagcaacgatgaatctttttcaagacaatcgggctggagcggagtacgacctgccttatctagtctaagggaccatatttttaacaattacaagaagtgattttagttggctacacaagataatccaaatatcgtatcaactacctctagaaagaattttcaccttgcatcaagtgtgcctgatgccatttaaatgtccctaatcatgtggcacagtataaaattctccttttccgtatgcaagtacagataagttatcatcctagcgaggtcttttaagtgattgtttgttcaacataccatacttgaacgaatttgcatttgaagattaaaacagctgtttgttttttgtgaatagaattgagactgttcttttcaagagaaaaacttcagtcacaggctaacttgggcaaatgtttatataaactgtaaccccaagaacatcactatccacagctggaaaaagtgattcgaagatcctatttcaagtgcattcaatgagaaagctaaccgtcctctattagaggtttctggcaaacttcggtatccttgattcgaagtataactgccgagagtaattttaagggcacagtatgtataattaatatatggaaaccattaaggataaccaggggggtctgtattgtccaaacattgttattactatcgtttttctcttgtcattcaaattcattgatacttaacgaaaaggcgcttaataatttttcactaacactactaacacacaaccgagctaacaatatagagattaccatgaatgtaattagcttaagaatgagaacacctcctaatcgttccgtcaccagcttgtgctttcctttgtcattttcaaaaaaggcatctcttggaaaggtaattccagtcaagagaaaaaaacgtgaagctcaaaaacgtaaagctttcaagcgcaaaattcacctactattagagtaaacaaggttttaaaaaagtgtaatcaggtgtgacaaactcttgactacaaagagaaaacaaataaaaacaatgctattaatactaaaggtgcctgttatctgtcagagtcattaaatcagttttatgtttttcgaaaatcagcgaaattttctcatacagtgtgaataaaggtatctcatcatgcagaaacaagaaatgaactcaaaatgaagtatcaaataaatatccgcctcaataaaacctatacgtgaatgttagtaagctagaacaaagacttcaaatcgagctactggtaagccttcttgtcgctcagctatctacgacctgtcatcagttgatacctgacagcacttcgaaatgtacacaggaaatgcgattacttgataacaagtgacaggtaacgtttatgaccgcccggtcggaatgttcatctttgcaaaaagggctagaaaaggattataacatacctaaaacaggttagtacaggtactcgcctctcaacttctgttgtgtttatgggggagctcatacaaggctgaaacttaacgagatacaatttgtcgacatttggaatttccattcagtcggaacaattggtaaaagtaaataatcatagcaacccttaaaaggatactcactttgttgaggtggccatttttggtaccaagccatgagcattcatcatatgctatggagaaaacttttcgaaacttgaaaacgaagggaagtcctacctaagcataattgtgttgcattggtgttaggagttaccttaacaaagctaagtagatttcgagtactctcattttctttctgttagggcttcaaaataatgcttacagttccttctgatacgtagaaaaacatacttagaaatatcaccgatcaaacttcaactttaactgaaagtttttcatcagaaacttcgccaagggaaagctctttcttcgtcggctttgccttgataatcttattggtagacacctttaatcgatcaattgattcaccccgaacaaccttttccatctcatctctcgtcaaggtctcaaactctaatagcccctccgctaggcgtcgaagttcaactgatcgctcctgtaatagtttgcgagcacgctcttcactctcacgtaatagtcctcttacttcctggtcagcttcatcccttatcctcgaggaccaggattcccattcatcgctcaaacgtatagggccgatttgatcagacatgccgtattgagttaccatagcacgagcaacactagtagcgttctgaagatctgatgagcagccactagtggtgttgtcaggaccatatatcatagtttcagcaactcttccgcccattgcaacatctaatcgagagtagcattcttttcttgtgatatcattcttatccatctcaggtaattggaaagtaacgcctaaggcacgaccacgaggaagtatagttgccttatacaaaggagttgcacctggagtgaacatggcagccaccgcatgcccagcttcatgataggctgttgttcggcgtgattcttcagtcatgaccattgtcttgcgagctgcgcccattaacaccttatctttggcccattccaagtgctgcatattcacagctgaagcgttctgctgtgatgcatataccgcagcttgattcacgacgttcattaattcggcgcctgaaaatccaggagttcctcgggcaattaaggatggatcgacatctttggacatctgcacattcttcatatgatgtttcaaaattgcaatacggccccggacgtcaggcaaacttacgttcacaattttatcaaagcggccaggtcttgttaaagccttatccagagactccggaaagttggtagcaccgataataattatgccttcagtttgagaaaacccatctagctcgaccaatagttggttgagtgtttgtttcgcatgtgcttggtccttagggtttcgctttcccccaatagcatccaactcgtcaataaaaattatagcaggagattttgctcgggcgtcggcaaataactcacgaactcttttggcaccaactcccacatagagttcatcaaactccgaacctgacataaaaaaaaatggaacaccagcctcaccggcggttgctcttgctaacaatgttttacctgtcccgggagggccagtaagtaacacacctttgggaagctttcctccaagattggtaaacttttggggatcttttaaaaattcgacaatctcttctaactccgcacgagcttcatcaactccacatacatcatcgaaacgcaccgtcgttccttccacaggctgaatctttgtagaagaagctgtgctcttgaaaaaaggtccttcttcttcaaagaaagtagcaatttccaacgctgcatatgttaacagccctatgctaattagatatttgatccacttagatgccatcatccatggtgattcagtgatccttacatataggggttcacgagggctattgtgccctccggcgaacgctgaactaacagtgggcgttgaaccatctaacaaatgagataacctggctgctttctctgtgtttcccatcttcaaaagtgcagagatatacaactgcaaacattcgggcgaggtggcaattcccggtgtttcgtaccggctgattacaacatgtggataatcagactgaagaagcattttgtaaaattcagcctgcttcaatggatttttcaactctctattggcagtttgttcctttgctgataactgggcaatggagtatggtagttccgaagcttgcgaggagtaagttctacagcctcttagtgaccttaagcattgtgaaacacttgagtgaaaaactaaaggtgacctgttcacattcagatgaaagttactgacaagtgttcgtaaggattttctacctgtttgtgacaccttcctgaacattgccgtgcgctccctactggtacagtttaggacctaattattaattactagttggtcacttctgacggcgttggctttgaactagtcaagcgcgaattgacttgtttcctgaacaggatattgccagcattattcagaacattcaagaagaacgaatatacatactatgaaacctggcgcaaatttccactgaacttcaggccgagtagagcaatgcttcaaaaatttctatacaactcatatcaacccgattcctaaatgtactatcaagtaccaaagggaagctaagtgcatcgaataaactcagcagtgattttacggcaaaggttacagattataaaacaccaaatatatgggtaatggttacgccgccctcacaaagtcaatacaatatacctccgtatatggcttgcttgattttttcttgctagaagtacaccgattttatgcttctctcttgaagtctctgaaaatcctcaaaggtagccttatcagccttaaatggggactaggtgtccttcaatttgatttaaaagatcagtgaactccagttctgtgtttgcactgttagctttgaatatatctctaattttctggcactcaatcgcaaaagatcccgcaataaccaaaacgtcattggcggtgataacctggagcaatttcagttggttttgcggaatttttgacgtatgataaacaagcttgccctcaagtccatatggttctatactttcatccggggtttcgactgtattgctatcagtattggaactagaagaatacaggcctatcgaggtggagaattgagtattgagacttgcagtgctgcctcttgagtactcttcaccgataacgcccccagggtgcctttctccaaaaagtctttgtcgcaactgcttgtctttgatataagcctccgccaaagcaatggacacactgtccattaaagttaagcataaagtagtggatatagtaggagcgctcaagccatagaggtaggattcggaaaactggtaaggcaattcggcgtaaagaactcctttcactctatgatcacgagctaggatagaatccctagtgcatgtaagtagaataactgcaatatcatttggaacataggacaaaagacttatcaattcacttgttttaccactcacactgatgaggattaaagtgtcattgttttcctctcgcaagagccccaagtctccgtgaagtgcttccgtggggtgcaaaactgccgaatgtagagataagctgttcatagtggcagatatcttagttgcaatcttgtgagacttccccacccctgaaatgactaactttccacgtttgtcaagagatttcatcataattgctaaacagttcttcagctcgtttaagcaccacgaagtccgatactggctgttcaaattgccaattgcctgagcttgattagataatatggtgccaacaatacctacgtctatatcatcatagctcgccttcgacattttaagagttattgaattgggccacctattatagaagggtaattaatggttttcgcccttgctaatgtggcttaaagctgaaagtacaattgagaactattatgcagattaccagcgaatttgtcaggcggctctaagcaaggaaaatcaaaagtaaagctgcttcgaagagataataacgtaggcaaaacgacttaagtccgacaaagggttttagagcagatatatatgtagccaggtgcttcttatagtaaaagaattagttatttcgattctagcctagctgaaagctcttttagtttaagtggttataacttactacttctaataatatgatcagcgttcaaatcgttgaaggagcactctatctcagttattgaacattgtggaggataaaaattgtattgaaatgaaagaagactccgtaaaggccttcttgtcgcctcaacaatgcagacaacagatacccaatgactcatcatggaactgttttctattttaccccttccctaccattgaaagatgaatcacaatcaagcaaaattcaagaaatagttcccatgattctttactaacggagttagtattgttattttattcaataatttagtgattgaaaactgttgagggtctaatcgaacaacataatttgctgttcgttaagtttgcgaacgtttagtgaacaaagtataatatatgtccgaaattcatggtcatctggaaactgtatactgtcaataaatttcaaaatccttttttctttttgcctttatagaacatacctttgctaagtgtaaaaactcattttctacacatggcacgatgttgtacctgagctagatcgctgatgcgcatgagatttactgtaaagtctaagaattctacctctgccatacagtatatttccgctttgggtaattattaatagtcgcgttctttgaagatattattttcacgtacaatcaatcacccttaagcactatactgaataatactgaataaccccatcatgacatccgctattctcccttcgatacaattgagcatcaactacaaagagataaaaagtaaagttaaagatttcttacttcacttcaaagaaaattcaagacaaaatgatggtaacaacgcagtagaattacaacaacctataaatatcgatgacaacaagaatgctgtgggattaaagtatatgaatcttcttcaggcaatagccaatagggaactgggcactctgtatatagatctggatgacattcaattcttcgaacagactcaaggttttttgaatgacacatcatctacgggggaagaggcattgtgcgagagaatagcaaagaatacttatcattttattgagctctttagccaggtaatagatgaaatcctgccaaatcctaatgtggacataaactacaaggatgacgtgctggatgtgatactacatcaaagaaaattaagaaacttgagaattcaagaagaagaacaacaagaaaactttactctttatgacagcactttacctcatccagaatccaacaggagatcgcaaaattccaacgaggagataaatgcatttcccgctaaactaattagaagatattgcgtttacttcaggcccctgtcgaacactaaggggaagaagacacttgccgtcagagaagttaagggcgattatttgggaactctgattacagtgagaggaataatcacccgagtttcagacgttaaacctgctgtccgtgtgaatgcatacacttgtgacagttgtgggtacgaggtgtttcaagaagtgactaccaaaacatttacgccactatcacaatgtacgtctccacaatgtagtaacaaccagagcaaaggccagttattcatgtcaacaagagcatctaaattttccgcatttcaagatgtaaaaattcaggagttatccaaccaagttcctgtgggacatattccaagaacattgagcatacatgtcaacggagatttagttcgctcaatgaatcctggtgatatagttgatgtctcggggatatttttaccgtctccgtatacggggttcagagcattgaaggcaggtcttcttacagaaacatatttagaggcacaatcaatccgacagcacaaaaacaagtatggcaagaatatcctcacctcagaagtagagacaaagattcgagagatacagcaggacggaaacgtatacagtaggctagcttcttctattgctcctgaaattttcggactcttggacgtcaagaagacccttctgctcctactcgtcggaggcgttacaaaggagctgggtgatggtatgaaaatacgaggggatattaatgtctgtttgatgggtgatcctggagtcgccaagtcacagttgctgaaaagcataacacacatcgctccgcgaggggtatacactactggtaaaggttcctctggtgtgggtttaactgctgcagtaatgagagatcccatcacagacgaaatgattcttgaaggaggagctttagttcttgcagacaacggaatatgctccattgatgagtttgataagatggatgaaaatgatagaaccgccattcatgaagtgatggagcagcaaacgatttcaatttctaaagctggtatcactactactcttaatgcaagaacttctatactggctgctgcaaacccgcttcacggtagatataatactcgtatctctccccatgagaatatcaaccttcctgcggcactcttatcaagatttgatgtcatcttcttgctactagataaaccgtctcgagatgcggatgaaagacttgctgagcatgttgcatatgttcacatgcataataaacatcccgaaatggagtttgagcctttggacgccattaccatgagacaatatatctccatggctaagcaatgccgaccagttatttcccagcaggtttcagattatgttgtccagtcgtacatcaagatgagaaaggaatctaaagatactgatggctcaaagaaacagttttcgcatgcaactccaagaacacttcttgccattctgagactatctcaggcccttgcaagaattagatttgattctcttgtcactttggaggacgttgatgaggctcttaggttaattcaagtgtctaagcaatcactgtatgatgatgacaccgaagttgaagatttctcaccaaccacgagaatctaccacttcatcagaggcgagttcctatctaatgggaaagagcctctcgatatactagatttgaaaactcggttattgaatcgcagctttacggaagtacaaatcaatcgctgtatcgacaagtatgaagatctcaatatttggtggcaaatcaatggtgaaaagctgacactgacgaatagagactaaataatcggatgcttgtaaatataatgcttcaatttaacaggttttttgctgaaagccagaattttatcctctgtttacacccgcttccacattctatatgtgacttatgggttcactttcattgtcgttttcgagcggcttatctgaacaaaaccaagaagatttgtatacacgaaacaatcagaatacagaatgatgtgtcatcaaggatataggttaatcatagacgcatttttttggtaatttacgtatctcattactattatgtcttcatcatgctcacgaatcagaataagagtactaaattaaaattgttgatatagccttgttggatagttttgagcaattagtctctttggcacaaagctggatttaacaagctgaatttcatttctgaaattagtcgatattttttaactcatattattgatccttaaaagattaccaacggaagccattctagtatagtggttagtacacgtcgttgtggccgacgaaaccttggttcgattccagggaatggcatgcttttttttctgctcaaaactattgaagtctaaaatgattctttctaaagtaacttcgaagttctgaagcgaaaagtgttgcgaccgttggtagacaaatatctgtaaaggtagattggttgattgtatgtacatttgcctgctacatccttcacaagacatatgtacagcctctaacttcccgaagaggacaagtgcgactgtcgagggtttcaaagagactttttcattcgtcaacaattccacctgaaataatccgtactacaaagctattaccataccatgtccacttcgttaaatgtaagttggttttataaattttgattcttgagactagtttcatttactgactatgaatacaggtttttagatggtctgctttggccacaggaattgtgtatggtgcttaccacacccaacagctgaaagtagctggaaaaatcaaccaggaccagtttaattttgcccgtagacagaatttaattaaagaggctaagctagaatatagcaaactgaatccatcacaggaagattcaaagaatgatcttgctaagattaatctggatgatgataagttagattttgcgaatgtgcttttgagagctgtagagtcactgaatgataactaggccgtacgtaatgaatgccaatgactatatagcagaatacaagtttggtaaaactgattcgtttttattttgtgcagatcactttgaagtattgaatacgtgtaaacgggttgatcttcagccatggcaatttgttagcttttcgagagcactttcaagttttttggtgtccagtttttgctttatcagattgatcttctcctgtaatttctaggcgttgctccttatagttggtgttattatagctctgtttcaattttcaccacgttattatacggttgaacacgcattcttgtacacctctcgttcaggctataattcacctatgttcttaggaggttgtgatgttagattatgctctagaccattaagacagtttagagcctcgcattccgcttacttcaaacttcggcgagtctgcgttcgttcattcacgaaagggtctgctggatcaggcggttcaactggttcaggaggatttgaaaactcatatcgaggctccaaatgcgactacaacattgccgtttcataccttccgaaagacaggttccaagaaaatgaggacggagaattgatacagatgctcaaagataaacttatggaacaaaaatccaaaggtcttacgtcaccaactggtgaagacaactatgtttgctcgttgggaaacgagagtattgcagtaggtgtagctgacggcgtcggaggttggagtgagctaggccacgattcttctgagattagccgagttttatgtcgtacaattgaatcttttcatagagacaatcagaagttggagccgcaaaaattaatagattctgcattttcttacataaaggaaaatgagattgttaaagtgggaggaactactatttgtctgggtgttttagacgggaacggtgctgcaaatgttgcaaatcttggtgactcatggtttggagttttccgtcagatgcctcctggatataaatttgagtgcgtttaccagtcgttagaacaacaacatttttttaatgctccgtttcaattggctttgattcccaacaaaatcttggaagatggtaagagcagaaatgccaagtatattgtagattctccagatgatgcagagctatatcattgccagttggagcatggtgatattgttttatttgcaaccgatggcatcactgataatgtttcagtagatgatttaagtcttttcttgacagacaaggtggcagagtttcgcaaaggagcagcaaaacctattgctatagattccaaaactcttttagcaatgggtatggaactaacctcaaaagttaacaagttgagcctagatgaaacataccccagtgtgtttgcacaaaggctaagtcacctcacccgaatgaggtacatgggtggtaagtacgatgacataacgtgtgtgctggtgtatgtggactagccatgtgatcacttgattactgcaaagtagtatcgttcatttggttcaaaataaattttctaatcctggcatcctcatgttgtcgctgggacacgaatttgagggcctcagatgcaaacgacgcatcctgtggtacttgtatttcacttgaagcagcctttttatccttttttgaaagaattttgaacttaacattagggttctcttttgtgacgtttggtatatcagaaggtcgagttacccttggtaagggggcaggtaaatttgttttatgtagtaaacgatcaagttttgttttgtttattgtttctttgaatctttgttcaaattcttcaagaagttgatcatccaagggttgatattgctctaatgcaggtgctacatttagattatcgatgtcgcttgaagtgggtttcacctgctcttcatcttccagtacttcaggtgtatattcaaccgttgatacgttttccctaacattttccagtttaaatgacccctgctctatcgttaagcaacctgtgaagcctaaaatctgataaacatctaatacagcaagtctgatattgtgaggaagaggccgtttgttggaacaataataatcaaaatgacaaaggaaatgatcaaggtgtgcacattttgaattttcaagacggactggtttggtacaatgcatcaaaaacgtggtaatcataaggactctggtatagttgttaggaggatccaaacttgaatttcccatactcttcaacgtcaagtcagaatatccgtaaaaaaggatatagtttaacaaattcaccataaaataaacaaaatgatcattaaatatccctgcattgcacaattctgcaagatagcgcatatctgccaatctcttattactcattttatagtcgttgtcctcgaggccaacagagactctttccataattttatctacaatagaagtgacaaaccatttgggacaagaagtttgtagaagttcagcaaccagctgtagggaatcagacggcaaagtctctggctgtgtgaaaagcagttctaatgtgcaaaaagtctccgagctttcgaacgttaggcttgccactattttctttaccacagcaatgctgttgggattcagttccacccttatcaattgcttaaaaaagttactttggacactttcctttgaaatcgcacttctttgcgatgccttgggaggatatagtatcatcaaaagatcatttatttgacttttcagttgaaaagacctggtaccagaaaagctaagctcttgaattagctccaccatttcatccatcatcatttggtattctttctccctagttagtactcttccacaattatcaaatatgattgagagtatttcaaaatattttgatctggattcaagggatataattaaggttcgaattttgtgaaaaattataaacgttggaacaatcttaaattttattaattcacaaaaaaaaatgatatctttcaaattaaatttagcagaattgagctgtattctaaacttcttatccaaaaagtctactatctcatcctttattggtcttaatgatggctgggaaatagcaagaaaacgggaataatatttaacaggatgttgattagagttggctagcatatgtctcatcaaatgtttgtctgacgccttgcactgtaatcctttttggaagtagacaattgccaaggaatcaacatctgaagcagatttgcaccgatctaacttttctaacaatttctccattctttccgccctgttctctagcccgggacgtataatattctcagaactggaacttgacaatgagtcgtcacatggatatggatcaacaaatggttcgggaaacgtctcgtaaaatcttctatcggcctcatcctcaaagacccaatagtgatgcaaactggttaggataaccccagacgttgaagttttatcattagcaaccaaagaactgcatgacggcatttctaggcccatgatgctagttaaatcttccaggctggactttatttgtctcagagtatggatttgatcagatatagaacttttatcacgttggctttcacggccagttttcattgccgcccgatcactagtcaccaacaggttgtctagagatctgtctaatttttcacataaagagatagccttcgtagtatacttagcaatttcatcctttaatcttttttgagtggcattgcttaaaagagagtttggttcaaaaaagacccaggaaaaccgcttaacatatgaggtcacaaaggagagattatacttgattatgctatcattcagaaagaacatcaatgtctgttccagtaaagcattcataagtgatttgtgacttggagattcgaaaagaaaaggaacttcacaatttcttaaggacgactcgttcatgaatagtccaactaaatacaactccgtaaagatacgcatgagccttcttaatacggtgagtctgcttaaaaaaacttctggtttagagtcaaaatttattgtaccttgatcataaatgtagaaaagtagtcgagttatcattgcctcagtaaaagttgcttgaaatctttgatgaagagctgaaactaattcgacagtggcgtatacatctgatgcccttactgttaaagcaaaaccctcaatcaggttatctacaatttcagataagtatctttccaaggataaacttttgacttctttcaccatcttttcggcatcttgaaatggagccttcaactttcttacaaacgtactattttttttcaacgaggaatctaagttggaacttaaaggtaattggtactgtccagtccaagctcgtagattaaggtcaaaaagttgttttctgtggctcacatccattcttaacttgaaacttgaaaaatgccaataaatcgtaacttgctaaaagaaaggatgaaagtcctttgaggtttaggcgagtatttttcctatatgttcgaggttctcaccaaaatacaggttagcagatgttgtaaatcctggggaaagagtggaaaagtgttgattaaactgtttacaagccgccaaaatctttatatcatttgactctatttacaatagcattattctataagttcggcttatcttcgaaccctatgaaatactctgccttttggaagtccatacatatcccgaacattggggacgttcctgtcccatcccgacctccagatatgtgcaccgacagcagtaagactgtgttgggcaacaaatccacgtatatcaaaaaattctctggcgacctcggaatcggtcaactccttttggttctgcctgaaaacccaaactactaaccggttaacaggggcattcttatcaggtactggggggagatagctaactaattctctttctggacattcttggagcttcaaagcatcaatagaaatatcagaactggataatggtacatttctcaaagcccaatgcagcgtggttgaaaaagtatcattctctaagtcgggcgtatcaggattgacaatcaaaaccgtgtaaagatcatcagggatcggatcaaactcaacaacttccagacttggaggtttcttcgtgacattagaagaaagtaattgtccaggctctactgtagtatggacattattatgaggaaatctcaatacaacgtcgcatctaggatctaacgtagaaagagtatctggaatggcatgcaaggactccaaacgttgcatcagcaacatcttgtcatggttttcccacttttctctcaaatatcttcgataaacgggttgcgttcggtctaatgaattggtctgaaagtgagatttgaataccacttcagggttgtgatactctgcccgcactaaaagctcttctttctgttccatagatagttcatttgcctgccgtgataaaattttataaatttgagtgctttccaactccaatatctcataggccagtggataaaccgtagagagaccaatgggaggcgagtactttattctagaggacctttttcggagagttgctgggccaaaaggtaaaccagcattcaataagccctgcttaatcttattactactgacagtcaaagaggtagacctcttggaaaagttactccatatgccagttccaaacgacatcactaattgttgaggtgactttgagtaaaattttacgtaaaacgacaatttagattatataagcgattatttgccaacgcgcagtcagaaattttgcctgtcaattgattttactaataggccattggacctttagtatttaaaagaaaaagaacaacccttagttttaaaaaaccacacaaacttatgcttatccatactgtactataaacaaagaatgaaaacaaataaggagaaagaagcggagatagtggcggctcttttttaaatacatcgagacacctcgcaaagattatatggggatgttcaatagccaactttagtcccaaagtaacttcctgcacatggttctgaattttagtacgcaaccaatgcgatagccttctttattaatttttaggtgagtgcaatgttggcggccgtcattttcctcgctcaggtgaaaaagaacagcctaatctttatgtgtattcagaattgaacttggaaaacgcaactggatgataggtgtccacaaggtactgataggtcacaccccacaaaagttccatatcattccttctatactgtggttttgtgattgtgctcgtaaaggtcgaaaatgaaatttctaggctctccatggctacatttaagctgattttaataaatccgtggtgccttaggacaatttgaaattcagcaactttaagatattctgccacgacattttagacctcgagcgggttcaagtttctggattagtccatattctttttctgaaacgtgggttgttcccgttcgcaaccgctgagatcttgtcattttctcccatgttgaaagagagaggatatccgctttatgcacttgaattataatgctaagtactggctgttgcgtaaaatttaccttgtaaaagattggatatgctaaaactgagctcattcttatcttgtcttgtagagcctgggaaagaaaaggtcttccatcttcaaaatgaaaaaggctgaggaatgagcattctccgatagaattaaaggatcgatcgttatgcctcaaagaaaaaattagttcaaaacatctcgcagagtgagcgcaacgtgggtacgttagttccttggggaacgattgaagatttaaaggcaggaattttggaagggcgttatcttaataatcattttatattacttctaggacgcaattatcggactattattcactagacttttaagatcctttaacggtgtatatcttcaatgataataataattgatgaaagttggcaagaaaactaacgtcccgatacaatatgcccaaacagattccttaacttggatggcattgtaggttattggggtggttccatcacgtgattacgcgactgaagttaggctccttaaaatctttctggttcaacatcatcatcatctcttgactaagcaacctttttttgttccatgatttcttccaaggagatacgaatattatcgctcctggtgctcgatacgatcttttttttgctggaggtagtcatcggttatgctgtcaactctctggccttgatcgcagattcatttcatatgttgaatgacattattgcactgttggttgcattatgggctgtgaatgttgcaaagaacaaggctgccaactcaaagtatacatatggatggcaaagagccgaaatcctgggtgctttagtaaatgctgtatttttactggctttgtgtttcactatttttatcgaagctatccaaaggtttatcataccacaagctatctcgaatgccaaactaatccttatagtaggcttcgcagggcttatttctaatggagtagggcttgttttattccacgagcacggtcatgatcatagcgatgtttctgatagtaacgctgaatcacagcatgggcacggccatggtgtaacttatgaagacgaagagttacaaacaggcgttcaggatgaagaacgcgataacttattggcttcgacatcttcgccctattcaagtcgtgctcgacgctctatctattcgttggaggacgacaatattgattcaattttgcccaacaatgtagtatcagaaattgagagagcaacatttcaggagcaaactatgtcacggttgaaagacaaaaaaagtatcagaagaaaaccacaaaatccaaaatccctgaacgttcaaggaattttcctacatgttttaggtgatgcattgggcaatgtgggtgtaattgcaacagctctaataatttggaagacagattattggtggcgtttttatgccgatcccgttgtttcattgttaataacaggaattattttctcatctgccttacccttatgcaaatctgcttccaaaatactattgcaagccacacctaccgccatcgaattcgaagaagtattagaacagatcctgaatgttccaggtgttgaatcggttcatgattttcatatctggaatctcacggagcgtctctatattgcatcactacatgtcgaaatcaatcgcaacccggaagagttcctttcgattgcaaaagaaatcaaatcttctcttcatgagtttgggatccattctgtcacaattcaacccgagtttgtgaagtattatgcgcagcaaaataagctcccccaacgattctcttcgactacaattttggcaaacgaagagcctcacgtcaacggtaatgacagtactccattgagtaatgttcagggatcacagcaacagtatggttcagtttctgatcccgattgtaattgcatggttgatgctacaattgggtgtgatgctgataaatgtctacaaatcgaaaccatcaagtagcaaacgaacttgcaactttaaactgatcggcatgaaagaactctgatcagttgaggctataatagattccaaaaattcagagcaattacaaaccaattatgacggtgaagggataaatttaaaaaaaaaaagtaactatatgtttctaaatatctcaaaattcgtaagataggactaaatcttgcgcttttaattttcttccttgcagtttcaggataatttatcggcccaccgtggctcaatgacaagcatctcggcctctgcaagcagcttaggggcatccgaattcatagacagcgtttctatgatacctttgacgtgtaccttgcgaccgctcttggacgttgtccacgcctttagaaccacaaaactattagccagtgttggacttcggtaatcgatcttcaatgacgcagtaacccctatcttaccactaaacaaaggaaatgcacagcgacacaaattttcatccagaagcgttgccagcattcctccgtggacaattcctggatgcccacacacttccgaacctaagtgaaaaatggcagtcagcttattctcatttaattcattggagttctccaaatgttccaccatggaaaaaatcaccggatgctttgcaatcttgtgttcgccagaaagtgtgtttccagttaacgagaccttgttcttgctttcatcaatttgcaatgcgtgatggacttgagttaattgggactcgtctcgaaggtatatgtagtaaggatgttgtagcacggtagaatggggatccatgatgcttctataaaacaatccttggaggttacaaataaacaagacttgtgcggcagccaaaagtaagatgacggatacgaaaagaaagcaaaagtttacaatttggtgacaagtattcgattgtttataaatgaatctataggagtctgctttcaaccgaggccgatcgtatgttagagagatacactacctactagaatttgaatcttaccagtacccatttatgaaatggatcttaatagacgatgttgagttgtatagtgattgggttgatactaagtattcgggaaaagaagcaataaagtctaaaggtgagttaccatcagaaccagtcttaaaacaagtgagacaggttccattctcaaaatacatgtcaccgatttcgtttgctactgagggagcaagatgtccaatccatttcatttcctgggcgtttcaaggagcctgactctgacaaactcctccctgccaggcaatagttcactgcaaggtcatcaattttaccgactaacatgatggtccggtaataatacatgtcaagaacatcatttgtggcactgactgacaacttgatttcagaaactggggaggcagacctaatacagacagtttcgtgattgaaatctctgggcacgatacgccaattaactttattgagaaactctacctctagtatgttcagttcactgacatgaatgccaccaaccttagcgtaatgagtattggaacaaaaactatcacataatcccttagctgcaatggtagttgctgtaagcagaaacctatgtacagtcaacgagttcagagaaaaaactgggtaagacaaagaaagcagatcaatataatatactgctgtcaacaaaatagaattctctaggtaagaatattgagccaaccttcctaagtaatgttcaatggaaatgtttggaggtgctctggagtggaaccttgtcaatttttgtgtgtgaatttgctttgattcagtcatgctatcattcatgtcaaccaaagattgaagtatacgggccagtaatacaaccaggtgatccctaggacagtgaataaactctaccggtaacacaatggatggggccccagttttcgaaggactaccgggattagatactgagaacacctcggaagagttattatccatttcgggctctaaaatactagtacctctgttagccacactcaaccgtttggtgggctctttcgagtggtttgaagtgttttctagtcttgccatctccagttgatcctggctagttatgttgtttgaatcaattcttccaatacctgaaatttcggaaacattggtctcagatttggatttagtcaaactgtaagcagaccaattactcgcaagaccgaatctcacggatccatccacattggggctttgttgaatatgcaagctcattgaatctaaagtgtgaaggtgcaagactcatatcatgtcaatcagtaaagataaccaagaaaacaagagcaaaagaaggtggaagaaaaaaggtaagcgaaacgaggcatacacccattctaggtagagcacgtgcccttaaaagaagaattacataagctaaaagttaaacgtaaaggacgataatagatctcgggcagaaatgtagaatttccgctttcattagggaagcaaattagtttcaacatccacacgttgaactctctccatccaagtggatgttgatggcatctgtatagtcatctccaaaatctaggctctcttcctgttggagcgcatttcgtgctacaacgtcaaaggcttggtcaatgttgactgcttctttggctgaagtttcgaaatagggtatattccctagctgtgcgcagagttgctgagcctttttgttgttgatttgtcgtttgttctcctctacgtcaattttgttaccgattaagataaacggaaaagtctcagggtttttgatattcgcctgaactaaaaattcatccttccaggatacgacattatcatacgatttattgttggtaacatcgtaaactagtacacaacaatctgctcctctgtaaaaagcaactcccagagactggaaccgctcctggcctgcagtgtcccaaagctggatagtcacatttttgttgtcgataacaagttcctttgttaggaagtctgctccgatagtagctttatactgttggctaaattttctgttgacaaactgctgcattaacgaagttttgccgacaccagagtcgcctagtataatcacttttaaaatagtctttttctttgaagacatggttgcttgtcaagaagtagcgctgtagatgttttcaccttactactcctgccatggtagctagaaattcgagcctttgtaccttccagtacatcctacagaatgtctccacatcgcctaaattaaagtctaggaggatacaagtaaaatcaatacagactgatttcagtttaaacgaatataattatagatgctttaaaacgattatttcttataaaattcctgggcagccttggtgattttgccggtcttgtcagtctttacaatgacttgctagggctgttcattcctcgaagtatttaactggtattgattaatgttgctttgggaagtatgatgatggagttcattagaaatgtaactacagcgtaaaaatactatagagatggaggcctgatgacaattttggaaggctttgacgatatgaattttaagcattgtaagaaataaccttggtattgtttactttctctgcgaatcttagacttgtcaacgtctcgttgaagaataatttattggggttgacgtttacaaacatcaatgtcttactgcttggttccaaactatattgaagcaggtatgtcaatttggagttccgatatggtatatggtggtggttttggtgtatggaatgaacgacgtaattgaggcagctgagtgacttattgatatgttgggtctccttaagacgatcccctatcactttggattgtgatatccgctcggagccagcaagatcaataaggtgcaaggtacttattaggcagtttgtttcgcagctcctaaaaacaaatcgaaacacagtgtgggatctggatgatttttcgtttatgttagttgcagaggttctcttgttttcttccgccttcagtaacatctcctttatctgctcttgtgaattcacaaatatttcgtccatccctaaaacctcggttgtacgagttgtcttgttatgtctaatctcatatggcttatttctcttgtgttcaagaagattaaacaatttgttattgtaaatctcaattaactgaacaaatatgcgaatatccttatttcgttcattgaatagcaaatccatagatcgagagatcaagccatcgtcaattttagacattgtgaatgatttcccggatccagtctgaccgtaagcaaaaattgtaacattagtgccctccaaggcacaatgaatcagcggactgatctcccggaatatatcagtattggtactgaaaggagaaaaaactttgtcaaaatgaaacgtatatgtcttttgttccttgataacagattttccaatacggttgttgcctgttgctcctgcataaatggtgatgctttcttttaaattccattccatgtcagaaatattaaacccaattgattcttgttcatctgtaaccaaaggtctgagccgacaatataccctcagatttccctttaagccttgaagcttattgtgtaagtttctagtcttgagttccttgttttggagcagacgctggtggttcgcagatgaggtcctgacctcttgcaaggaagattcaactatctgactatctttgatttcgtttgccgatgatttctgggtttttctagtaattgtcattaattttagttgttcttctgtattgctcttttgtttttgcatactcctataatcggactccaaaattttcctttcagacattaaactagggcgcttaactgatatctgggatagctgattttctatgctacgttttctgagaccttgcttcataatgagcaagctaaacgttttctgttgactctgattggaccttacaaggtgtaccatacaagactcaaaatcccgaacttgttgcgttaatcttctctcagacatggtagtaatgcctctcaatactagtttattcgcctttaaggtctcgtgacattctctctcatctactgcaagttggctcaactttgtattgatgatcttagttttaacatcaattagtgattgtttcaacatatttgtttccctcctgaagagaaggaaggcctccttctgttgtaagtgtaatttgagtttgaggttccgtacgagctgtcgtcttgtttcaaaaaccttctctatttcactttcatgccatagtgtccgcttgtagagagcttcaaactcgtctcttgtcttctcatagcagtaccttagctttgctcgttcattgatgagttgcatcaaagtatctttagcaagatgaaatttttcatcttggcaccaactttcctttagtaaataactcataaggattgaaatcttcgatgtacgagcacaaacagttacctatggcatcaataccatagcgtttacgaaaataaagtaaaaccatctttacaccagatgcaggtttttccctacgaagatggctttcgtttgataacttactttcttttgctagagggaatagctatgccgaatcgtcaaaacttacgaagggctgagaaagactcagaagcatctgtcaggtcaactggatatgagggcccaagcacttgtttgagcaaaccaggttttggaaagggtgtttcacttgaattcttcaaccacataagtgatgtgaatctcaaggaagactctagcattgttgggaaagctggttttcgtcccaatagtaaatttcgggaagtgctaagtgatgaagaggacagcaattctccagtggaaatggatttcgaagaagttagtacagaagatagcgaagaacttgatttgagcacatcgaacgataagcgaacaaagtctacagatggttctgatagattcagtaaagccgtaacttctattttggattcaaaactgaaagcttatgatagaaaagatcctattttggcaagatccaagaaaggtatcaagaagcttgaagaggaaaaattagagaagaaagccatgagattgattttgcaagaaaaaaaagagagattaaagcattctagaaatgaacacatacttcccacagatgacgataatgtaagagccattattgaaagggaaagatttttcaagaagattgcccaaaagggagctattagactttttaatgccatattagcaacacaagtgaagactcacaagacgatggaggacaccaaaacagagatcttagggcgtgatgctcggaaacgggtaatgacagaggtttccaaagataattttttggatatgattcaaagagctggaaaaagtacctagttgttagggtagcggtctttgtaggagttggtatcattcagagagattgccgttagttttggcaagcctgagattttaactagaataatagtaccctgctctgtaataaccagcaatgatactacagattataccctacttaaggaggtcttcgacaagtaacagttcccatgttgagaaaggttctttgatggttgcagttaccattgtagtaagaacacgactatctttgtgaacccagatattgattcatttcatttaagtcctagtttcaagtaaaagtaaatcataacctacctataagtgatcttatcacgcaacctatttgtcaacctaggttactcctaactttacacacgatagaaaagtactcgtgctaaacatgtgggtataatttcgtattattagtcagtcattggcatatttccgttaaaaaaaaaaaaagaaaaccgtatctattaatgtgaagaacaaaaaatccagtaagagctccaagctctcgttcatctcagtagtctgttaatatccacattaggataacctatacaggattgttgtctattactcttaagctttttttgtttcttggattgcatactcatcagtatcaaacaaggatcaaaagcacaataaaatttacttttttatccatattctaagaacagacagtcacagagatgcggggaatgtcattacttcagctgactggtgtatgcctgatataatagaataccgttgtcacatgttaaagcgtgacgatttactggctgagcacgtaccaccactatataatcttatcaattagccaataaggaacagcaataagaaattgctgtattattttgccaaccatgcttgcatcgatagaagacttatcaaaaatgaactttcaaagtttttttattcctcttgaatagaggagtaattaacaggatcgtattgttctcgtcttgaatctctgatcgctgtctcttgagtactaggatttcttaaatccatacggatatgggcatagttggttctgtttaccatatctaccagtcctggaactatccttttctttttcaattccaagcgacctacgataggtacgaaaaaagctctgtccgagatgtcatcaaagctaatagcaaaatcttcgaataatttcttatggccacgaaacatctgatcaaaatctttgatatggtcataaattacgtgccgatttacaatattgtcatccttgattgaattaaagctctttctaaaactctccgccgataatttgtcagtaactgcatagagagatatccatttgttatggggattgatttcaataggtttgaataaagaggtgagaattgaggcattgacagaagtagaatcagtttcggagacctgtcccaattgttcattaaggggcctatctttggaaagagaggccgaaccaacaaactttagtgaatgaaagacttgatcaaatgtagaggtatcaggaaaaaagtgccaagccttaactgctttgatcttttttcttggatgaatcaagctctgaaggcgattcttatttctggggtcaataacttcgtcaaatgttctttcaacagagtgtaactgcgatctaggattggtgtcttccatatcctgatgctttctcttgtttgtaaaattctgcaaatttattttttctccatcactgacatattgtggtctacgtaagaaaaaaacaggtgattcctcgtttaaagtagcacttttgttgggatcgaccagtagtagtcggtcgtctggatgaagattttctatagcaagattcttatatgatgagaaaagtttgcctaaagatttttcattttcgataatcccagggatgcgtaggtagttgacatctaatccatcgctggtttcattcatgagatatctaaaattgtctttgctaaacagtgccgataacaatctactgtctttcaaaaactctttttgaggggcctctttttcgatttcatatttcagtagcttaggagggcatggtggagcaggtagatcgttttggtaacggactttagcaatatagtcttgtctggacttactcgacgtcattaacaactgactgaaacttggatagaagagagaaacaaaacccaggttgcgcgttcgcggaacaaaaataatctgcaactcgtcttgagacaaatcaccctgtccagatcaacatcgattactcttatgtaaaatatatatgcactcatcttctatgtagtcatggctgccgctctatcttgtatcgtatgaaattttggggtagtcaatgaaatcgcttggatctggtggaggtaatggagaaggtgaaacttgttctgttcgtaatgtcaccgaggcttgacctactatgcgaccccatttcttttttgcttttgtaggagacggtaagtgctccgccacttcaacattaactgctggatcagtttgattgtagctacttggagtcgcggttccgacagtttggactccaagtttttgataactagtatcactatcaaactttggcgcaaaaatacaccatcggtagtctaatagactagggagttcacccagctcagaagcttcccaaagaaaagcagcagaaactattggaattgaccacttcttagcggcaactatcttgttcttcgttgacttagcgccaagtttagtatcactgggtgtatcaattatctcggagtactcatagctgaaaaggctggaagatctatctttcttgaacccaatcccaaggacggagaggttgataaccagtaaatgaccagcctttgttagtgtgccacaatactcgaagcctaaaattttaatcaatttaatgatgtgcaacagttccactccacagaatcccgtaacacataccttgagattaacaccaagcttggtgtaacaaagaggtctgccccaacggtcgttcattattttcttgtaatgtagtgatcgttccacgaaccagtctgtgatgatctcagttgttttcggaaaactttccaaaagcctccctggaatagagcgccgagtaaaactatgtggaactagcaaatgggtcatgcagccaaagttttcatgcttgccactgtcacagaacttcccaccagataaagtaataactctgcttagtatcgaaacttggaattcattgaatccatagcaaaaaaaatgaaagccagaaaatatgtttgatgtcgcaactgagattctaccagcacttgggaaagaattggctcccactatctcaccctctagaggcatctttttggccttttcaaaattctttttaacttctccgccttctattcttattgagtcagtaccccagacattcttgtcatgcactgaaaaatctgagggtttaattccttccatgatagatttccaaattttgggattgcgtttcacaactttcaagtgatcttcctccgtatttcgttttctttcccgtgatttactgcaatcatgatacttctttctcacatcctcttccgtaacgaattcatccagttccctccaattacaagctccctttcctagacggttcgcaggcaatttactaatatcatataagttcatatctagcattgccccccgtttaacagagtctgtaacccagcgtaaatctagtgtaggtatcttccactctagtgccttttcatatctttttccagatttttccgaagtaactatacaagactttcccattgttagggcctcactaactttgccaccacggtcttcaattaacttttgaaattcctccctctgggaaggctcttttgttctagttaagcataccctcaagccctcgaacacaggtagctcagatccactaaaagaaagctccttcctagtaccttgcagccactcttcatagatttcctttatactcttaggtcgaagaaagatgatatcggggcggtatttgacagagtaccgaaacttgtcgctatctctgtcacccacaattagatatctgacatcagatgtcaaaggattgacgagggttccacccatgtcagatatcttctcagccagatcgtcctttatatcctgcgggatacacgtaggacaaaataggttgcctttgaaaggcttagacatgatatgcggttggaaaatacagaaatgaagactcacgaattgataagagaagaatctaataaggggattgattaataggaagaccaagcgagactgcagacaactccacccacctccagttcttttcgctagtctcactattgagaaaaaaatttaccttttcaaaattttgaagcaaatggcaatgcgaggacttccaaggccattacttctatcaaagatctcacgaactataagaagtgtctcatcatgttcacttggaactgaacttaaccttaaaattaagaactcaggcaaggtaccggttgctttagacgactctcaatacccagaatggctgtggactgttctggatgatgagtatcaaaattccagcctagctaatgatgctatgaaacagcgtaagaaggatatcagaataatgaacatcaaaaagattaaaatgaataactttatcactaagatcaaatagtgctgttaatactgttcaaatggttcaagctggattatcgaagataggcgttccggttttccttttcatcctgagtgagactagacactctctggttgaacaactacttcaacaatttataaactatccagctttgtagctaccacggaaggtagtagcctcaggcggcaatttatactatctatttatctctcattcctttttctatatacaaaacaaacgtaatactggctggtgttgaggctacttggcatcttccaaaaacttaatctttttccgaacatcaggttgctggtctgcaaaagcaacgagattttgtttgtaaggatgttctgagctttcaaaaactcttaatctttgaagcctttgtttcctgagcttattcttgggtagcattctgctcactgccttgcgaagtatttctccgtatccgtggtcttcaatgattttagaaactggtgtcgactttccggaccctggccgacccgtgtggctccaatagctcttatcctttaccttcttacccgaaagttttaaatgctgacaatttgaaaccacaacataatcccctatatctgttgtaggatggtaaatgggcttatgctttcccataagagtgacggcgatttgcgatgcaaggcgccccaaggtacgagaatctctcgacaaatcaacattgtaccatagccgggtaaatgctgtagtagtcttgcctattttattcgacattggtgttcagtttgcctcgtgatttctgcaattctgacagggtttcgaaattatcccttactccaatatttttcaatcaaaaaatgtgttcgtggtagtgcactacataattctgatgttgaatcttcttgagaagccaggtgatcacttcatcacttgcaaagaatatacagatctcttgtacagcttagaatcacaatgttctttcttaaagatctttctttaattttgactcttcatccgtcatactttggaccccagatgaatcaatatcttcgagaaaagctactcactgatgtagagggtacttgtacaggtcaatttggatatattgtcactgtcctagatgggatgaatattgacgtcggaaagggtcgaattattccaggatccggttctgcagagtttgaagtcaagtatcgggctgttgtatggaaacccttcaagggtgaagttgtcgatgctattgtttctaatgtttcccctataggattctttgctgatgtaggaccactgaatgtttttgtaagcacgaggttaattccagataatcttgtgtacaatccttcaaactctccacctgcgtatatgtctaatgacgagctcattacaaagggaagtaaggtaagactgaaagtagtgggaacgagaacggacgttaatgaaatatatgctattggatctattaaagaagattttcttggagccatataagctaacataaaagctgaggaaaaggaataaagaaaatgccgaacgcctgagctatacatctcaaagtaatcacaatgggaaatgctgggtttattattttaacctattggaagtttctatcgaccaaatttcgaaccagataccaattgtcttgttcagcataatccaaaataacgattccagacccctttccaaaagactcttcgatgttggctttagttaacgcttcagcaatcttcgccggccaacaattagggtcgaagaaattagatgccgagcaaaagttgacaaataacttaggctcactcttatttgagttatattctttagcccggtaaacgtgatttttgataaagttggcttttctttcaatatcttgtccagaagatagttcacaccaatcctgaacattaatagttcctctgtcatcattttcacagttgtacttccaccaagaagcctcaattccaaaatccttctttctgctctcatctacaattccaaagcgacgaaacagaattgcttttcctcggacatctctcaggtttggaattccatcattcaagtaccacttgtccctattattgttaatgtagtgattccaaatagcatccccgaattcgtcgtgttcatgattccattttgcggaaccctcttgcttaagggaaatgatcacaaattcagagctatttctttctaggaactcatacacgtcctttagaaccgtatctaacttcacatttccaatcagcttcaacggaaacttgccatgaacgactattagatcattgttcaccgcctttttattatcgattagtggtttagacactcgaatatccaaaaaccgaactccattttgaagttgttctgttatagaagcatcttgacattggactgaaggtagcgcagtatggtgggctgcagaattgtgcgttccaggaatagaaattctgctgatgatttctgtgtcgcttatattttggagccaggtggtgtattgaaacattcaaacgattcttgttcgtaaggaagagtacgaaggagcactggttccattctatgaaaagctttacttcggaatttcccgaatctttcgcgtgctgctaggcagccaatgaccatagtattatcatatagacaaaataattattatagcagactctagcttatcagagcacttagccccacaataataaggttgctgattaaaaagttattgaagaagatttcaaaattgcttctttttgtaaaatttgtgatcatttccgtgtggatttcttttctaaagctcaccatagaagttattatctctcgaaggatcgcatcgatgaacttgtttgtgttgggattctgagtagcactggaaagagcgagcactcgtaggggatcaataccctccagctcgtctaactgccttaccatcctaaaggttatcacaggcaagtggtcactcgtatccacataatgatccccaacattatccaagggtaaatccattgggtcaaaggatcctgagtcttctaactcctcaattttgctttgactggcaaatttcttgctattaataaatctcactagcttactcaattcttcatgtgatatcaatggaacacctagcgaatcatgaggtaattcttggggcatagtgcactgtaaatcctggaacgagactttgaagtcaattatagtatacaaaggttcacgttccttatcttccaaaccttcatctgtactgaataatctttcaatcacttgtgagaacgtagatgattcctgattgccagtaacaggggcgctaggcagcgttacatctaccagtaactcaaccttcccactagtaacccaattaagctttgcggactttggcataccgttcagttccaattgatcgacccttaatcttgccgttcttttccaaggataatcttcggcagtaaacgaagtatttccatcgccgaaggtgttccttaactgccgttcatgaatattgaacaaagattcgttgatggacccggagcagtggttagcgttcaataaatcataaaaaacccaaagaggccttaactgattcaattcgcaggaaaagatagataccttcaaagacttgtcgggtctggccaatacaagctcaattcgtgcatcctgaatcttaaccgcattaaaagaatagtttctgactctgctgcggcctattgaaagccttggtgataatccctcttccaaagaagaattgagataggcttttccattgaggccttttatatctacagtatcaatcagacccctacccagataccacttggtaaacgaaagagttaaactcagcgagttcacatggacatcataaagtatgttctcattcttctcatccaaattacatagagtaacattttccaggatgattcggccattttcatatcgtgattgcatattaccatttgaaagaatcagcaatttggtgtcataattcaacaaatctagcaatatcctcttgctcattgtgctgtcgctaagcccagtgtctgctatgtagagtaagaggccgacaaaagtggtagttccaatgacgatccaaatcaaatttcccatcacgacccaagaaaatattgccgagagttcgtcaatattataaggcctattttgccttatgagaaaccatttcaatctaatcttgagcttagacagaagcgtagtcgtataaagatacctttggttctgatctcgctgtcttccatagtacctgaacgagcccttattcaggataatcgatgggtggcgcttattcagtacaccagacaaatattcatgcttggctttatattcaaagcagcttgaaagtcccgtaccgttataatatctaaaaaatctcaatgagtgttgtacccttggtcgaaaaaacctacaaccaaaaagtacttccctattaactatacttgacatcaagtgaagtagctactttaagttctcaaaaatacctgatactaccaatcatgaaatagcacgagacactggaagtacagttaagcttttgtgtaccttttctagggaaggatacttgctctgaggcatacgttttttttagctacaaagtattatgtaagctttatcacttactgtaaatgaggacatgcatacattgtatgattgaataatataggtcataattactatatattacgatggtagcttacctgccctaaagattcctggtgcaaactctgtttagtatcatccactcacccgccagactctctccaccagttcatagagtactccactagttaatccaaaaacaaaagttttcaggtgctgtgataaaagactcatggtattttcataggcccctgcacctacggtcatttgagaacaaggactagccgcaagaaacgatttcttgggagctatagcacatcggggtggtgtaatcgttcttttcttcttattccattcaatttcatcccgtactctctgtttcatctagtcaatacagatttgagacgttaaggtggttcatagcttgagcaatttctgcaatacttgttttccaatttttgaagtccttgttttgcaatacatcacaaattatttacttatttgcagcgacaaccgtcgcgaggaaattgacacaggtttgtcacctcgctgaggtattccttctgcactgttattcaaaagtcgactacaagatgttataaggggtgcaaataataaagcataatcgaagtaaatgacattgaattttactctcaatacatttttttttaccaaattgagttagttggctgcagggaatgaggccaaaacgaatgaaaggtccattcatacgaggagatgattgcaaaaaggttcgcgcatcattaacaaaaattttgtcaagggccagatccaatagttaatgcttgcgttctcagcgccatgccgtaaccaacggagccaaaaaccacaccggcaatccccagcaccggattctgctggcgtactttcttgagcaatctaattagatttgtacattgttatcaaaacagaacttcaatttcgggtgtgagaaagcaaagtattctgtttttttttcacctagaaaatcgataagcatcgtatatcgtatcaaatggtgttaggcgacaggatgatcaacgccactgaagagatgaagaataaggatgtatttttttatgtacattttggtccaggaagcctaatgtgagatgctggaactgtggttctacttcaaccattatctctccttacctgatctctcaactggtgtgtggggaaaaacaacactactattaatgcaactttcagtaagatatttttctggattaagggagatttcaagtcaattccagatcctggctttgcaaccttcggaaatgattgcaaagtatagtctttttccttccagttacggtggccttgcagcattgaccagtggtccccttatgcagatcataacgtttctgtcgtttcgggcagagagaatgtttctactatctgtcgttacgtgcatactcaaaacgaaacctcggtttttggttttgttggaagaagtttactgatatctagggatcaagattttacaatgctagcccaaatccgaaacgaatagtttcaccgtctggagggaagattcccaagtaaaacgggccttttgtccattttctctaattcctttggaatctatacgatccactaaaagaatccagcgttgctatcccacattctaacagctgcgtcaagtgacacagtcgcagttacgtttccgtctgggaaagctacggctaccggccgcgagtccatttttgattaataatgtcaacatacactgtgaagaaatcaggtctagatttggaaagatctgtcttccaaaccagcgctaatccagttccattggggaaaagcaggtagccctaatacgcaagggaccattatctgattcataactgctatttacgttgtctctggagtcatcccacagcctaaccagaagttctctagtctggacatcagacatctgagtcagtcaattgcaactgttagttgaaacctgccatcagaaccggcatgaacccactaaactcctaacgctggcagatagaaggaacgtaccatctcgacttctgtctcattcgctaatcaaggttatatgtagcacgtaatttgcaatggctttgtctcttgtctctaaaacgctaaacacgcattaaaactccctaaacatgcaaataaaggtggtagcgggccgcagctacaaagtttcacctactttcctcctggctgttgttcagagtaccgagcgttgaaatttggagtggcaacgattggagatagaggatccattttccagctctacttacctcagttgtagctacatgtggctaccaggtttttcctggtcctgtttcatgaagtatttcctttggtaagctattctcgtcattttaatagctaaactaaattctttgaaccggatttcgcatttttaggaggcttctgtcatctgtgtacacctaatagccagtaactcagagcccacacttaccgattcactgatttttgccttaactttgcccaacaccgtactcagttgaagacgataatttgcgccttgcgctgttagttgaaatccgcaaggataaaagagctacaaagggtacgagcgtacgtgccatcgtttattgctgcttaacttttaaatttagttttattcactgcaggaatgattgaaattagatagataccttgtcacattaagatgaaactaccaattggaactctcataaaacgatttacccttatgtctcaatcaagaaaacatgacataacaaacacaacaaacgcaccgtcttgttcaaagttagcaacataatcttggtttagtttcttgtttggcattatgcgaaaagaataggacaattcattttttccctgtaccctttgaagagaccacaccaataacaaaaagcgcatttcgcgaagtgtcacttgatagatataacctaaaacgtcaaactattaaatcctcataagcgaacccaatcattctggttgacaggcataatggtgttccattcttctttcatagaggctctattcaatgacgttcacaaagaagaagcaagtgccaattagtccaaatacaaaacgaagttttgttaaaactttcaatagcacggataagtggttacataaatttttggtatttcaaacctgcggcatttgatctcacatagaacaactaaaggaccacgctaccttcggcaaccatcggaaacttagaatgaggagcatgtttgagtaaatgaaacatactcaacagtgaacacaataggatgcatttaagattacatgatcattagtggattacttaagaacatcttcagcattcactaggaaaatattttatattcaaagaagagtttgtcagcctacgatgactctcattagtgagacgactaaagtcattaataaatttcagtgacttaaaccaatacgtatacaatcaggtcaaaacatattaatagaaaaagggtagactcggtcactcttgctaaaaaccagaaggagtactaaagctcaacatacatagtaagtaaattaagatcaaaatgaaactggctacttgaatacagagctgggaaaacgcataacgtttataaatgtattaaatatgagatggtagagttctgtttgattaaaaccgctgaaaatagttgcttaccaagtggctagatctggacggttaagaaagtagctgctgttgtacaaaaatccaatcgttggtgatcagagcaaggactattatgctgatgtaatagaatgcaatgcttgtagtcaatatttgttcatacctgacataaaagtactttccaagaaaactggtcagttacaaataataagattagaccggtgagtgacttagcacattctaggcaaaaatgaactgtgggatgcttgccactaactataatactatactgtaaaaataactgttcaaaaaggacacttatcggttcgtaagtagatgacaggaaaataaggggccatcaaacaatagatattgaaggctagcatattggtagttgttcctgtaagattaatgtttttttggggagctagttcatcataaaacagggcaaaggccaggaatcaatcaattcacattagaacttggttgataacaagggctcccacaattaatcgtctaagcgattctcagcggcttgtaagcattacagcgaggttaaactttagatgaaaggatcattattctttgagcgtgttaccattatcagggtagtaggattgaacagaattatgcttgctaaacacagatctcaatccagcgaataccatgatatgctcaaagagttaatctacccatgacccaagctcagtatacggtgagtattcgggggcgcgcaagtagtttccttcattccactacatttcgatacgtgttaaatctaattgtattcttgaaaagaaagcttggacgaggtcatcagagcatcttactactacgtgatgatagacacagagttgggttacttttttaaaaaagggttgacatctatgtttgaactcatttcagtcaagtaatcatctgagaccatacacctgcatcaactacacattccagcaaatatcagcttttccaaacggagaatgtagcaaagtcaacaaaatgaaaatcgacgaccgcaggatggacacatctggagctttccagaatatcaagtatcaagtggagcggtgaacgaaaaatccaactaccctatcctcatttaaaactctcaagaaaagtgatctctcagttcggtaatcggaatattaaaagatttcaacataaaagaaagaaactacctcgaaacgaatatgtacaagcattgcataacaattcaagttttcaaactagaaaaaaaattcctatcttgtagtccccttaatcacttttgagaaatagaatgggagcaggcaacacgaggcatgagttctttgcttttaaccaaaacttacagaagaatctttacacgtttggtaggcaacaaaactataccggagctcagtttgcaccaggcaaatgctccaaaagtatgaagctacgagaatcaaatcgtcagactaatcaagataggtcttgcattcttgataccgatacttatccatccctcatcaatgccttcgcctgtctacagctattgatcatattgagaaatttggtacaaggcttttaggaacgtttcacaactgtcagcagcatgatgtcctctaaaaacttcttaatccatatataatcagacaaagcgtgactaatctgtactacctctgtatgtgtggtcattctctttacgattcgtaaaacactacagccttctttgcaaagctagaatagcacatacctaattgagtccattgcgacagtaggcacgaaaatcccctttctatctaacgtcgctctagcgcaactaccgtctttcagaagaaaaagaaaatcacagccaatttatgaaagcaatctaagcttcctatcaaaatgatcatagcttatgtggcaacagaacttacttagtttttaatgctggatgctgtttgccccgttaatggaatctgtggttagactaatcttttcaagccataagacagttatcattagaacgaataaatactagtcttctaaatatacgttttgtttagctatttcacgaaagtattcattagggataggacttcccaaagctataccatttgaaaaaatgatgcgcttagattcgctcgaatgctgaatgaaagtcatgaaactcccaacttcattgtagtgccagagagtacccagcatgcggtttaaaaacagctcttttgcaagagccatctgctgctgaaggttcaaaataccttaaacgagattgttaacaaagtacaacttatacatcatgacctctaagctaataactcggagaagctcaagttggcccaaatgtgtgacaaatcagtcacgatccaaaactatcagctttcaaagttcatggtattattgttttcttgtaagttggctgaatttaagtttggtattctgctgaaaatcaagatttgacttagatacctatcaacaactggcaatgattcttgtttttgtgctatgaatcagaaagcattaaacaaggcgtaacctcaagaatcgtactggcacctatgcaaatgatttggtgacaacatcccatctcacgagcttgagcattgataatgcaggtaacactattgctgaacaattacgtcgtctctatttaatatcatggccttgtcagcatcaagcaatacatgtagtaattttggcgcctgagatgctgtgcattttcaacgcttgaacattgctaatttaaaagctaggatttagttaaagtagaatatgggtaagaatattttgtaaaccggtatccgacattcggtgctgaagtacacagagttaggtaccaggagttactttgcccatagtgcgatttttctcaacaattgggtgtacctgtctagaaaatagtcaagaaagcaatgagctgtaagtcttaaattgcagattatcgagagtatatgcaactttggtcctgaggtcctgattcttatgatgaaatgcttggattgctttcataaattggctgtgattttctttttcttctgaaagacggtagttgcgctagagcgacgttagatagaaaggggattttcgtgcctactgtcgcaatggactcaattaggtatgtgctattctagctttgcaaagaaggctgtagtgttttacgaatcgtaaagagaatgaccacacatacagaggtagtacagattagtcacgctttgtctgattatatatggattaagaagtttttagaggacatcatgctgctgacagttgtgaaacgttcctaaaagccttgtaccaaatttctcaatatgatcaatagctgtagacaggcgaaggcattgatgagggatggataagtatcggtatcaagaatgcaagacctatcttgattagtctgacgatttgattctcgtagcttcatacttttggagcatttgcctggtgcaaactgagctccggtatagttttgttgcctaccaaacgtgtaaagattcttctgtaagttttggttaaaagcaaagaactcatgcctcgtgttgcctgctcccattctatttctcaaaagtgattaaggggactacaagataggaattttttttctagtttgaaaacttgaattgttatgcaatgcttgtacatattcgtttcgaggtagtttctttcttttatgttgaaatcttttaatattccgattaccgaactgagagatcacttttcttgagagttttaaatgaggatagggtagttggatttttcgttcaccgctccacttgatacttgatattctggaaagctccagatgtgtccatcctgcggtcgtcgattttcattttgttgactttgctacattctccgtttggaaaagctgatatttgctggaatgtgtagttgatgcaggtgtatggtctcagatgattacttgactgaaatgagttcaaacatagatgtcaacccttttttaaaaaagtaacccaactctgtgtctatcatcacgtagtagtaagatgctctgatgacctcgtccaagctttcttttcaagaatacaattagatttaacacgtatcgaaatgtagtggaatgaaggaaactacttgcgcgcccccgaatactcaccgtatactgagcttgggtcatgggtagattaactctttgagcatatcatggtattcgctggattgagatctgtgtttagcaagcataattctgttcaatcctactaccctgataatggtaacacgctcaaagaataatgatcctttcatctaaagtttaacctcgctgtaatgcttacaagccgctgagaatcgcttagacgattaattgtgggagcccttgttatcaaccaagttctaatgtgaattgattgattcctggcctttgccctgttttatgatgaactagctccccaaaaaaacattaatcttacaggaacaactaccaatatgctagccttcaatatctattgtttgatggccccttattttcctgtcatctacttacgaaccgataagtgtcctttttgaacagttatttttacagtatagtattatagttagtggcaagcatcccacagttcatttttgcctagaatgtgctaagtcactcaccggtctaatcttattatttgtaactgaccagttttcttggaaagtacttttatgtcaggtatgaacaaatattgactacaagcattgcattctattacatcagcataatagtccttgctctgatcaccaacgattggatttttgtacaacagcagctactttcttaaccgtccagatctagccacttggtaagcaactattttcagcggttttaatcaaacagaactctaccatctcatatttaatacatttataaacgttatgcgttttcccagctctgtattcaagtagccagtttcattttgatcttaatttacttactatgtatgttgagctttagtactccttctggtttttagcaagagtgaccgagtctaccctttttctattaatatgttttgacctgattgtatacgtattggtttaagtcactgaaatttattaatgactttagtcgtctcactaatgagagtcatcgtaggctgacaaactcttctttgaatataaaatattttcctagtgaatgctgaagatgttcttaagtaatccactaatgatcatgtaatcttaaatgcatcctattgtgttcactgttgagtatgtttcatttactcaaacatgctcctcattctaagtttccgatggttgccgaagatagcgtggtcctttagttgttctatgtgagatcaaatgccgcaggtttgaaataccaaaaatttatgtaaccacttatccgtgctattgaaagttttaacaaaacttcgttttgtatttggactaattggcacttgcttcttctttgtgaacgtcattgaatagagcctctatgaaagaagaatggaacaccattatgcctgtcaaccagaatgattgggttcgcttatgaggatttaatagtttgacgttttaggttatatctatcaagtgacacttcgcgaaatgcgctttgcccaattggtgaagattatgtttttggttaatccttttctcggcttctcgttaaggtgttcacttcctttttttggaatgtttgtaaaggatagaatttaacttgatactccggatactttcggaaccttgttgtaatcaatattcaatctaatcactttttaggaatcacttgtagctatgatagtcttatgttgtccctaatcttgatgagctgctcgtctacatcaatttggtgggggcttggaatgttttcaaagctgttatgcaaacccgttgatggcctctgaaccactggaattgaaagaattaatgtcctatgatttaatatcagcatagatgcaaccataatctggatgttatcgcccctcgatctaaacattctgggtacgctcagcgatatttttgcaccatctttagggtagcatctaactggaccctaccctcagtactgtgagcgtcggtaaaatagaagctttgactgcttagtattcctccctcatcctatcgtttgaatttttctaacaagacctcctagatatagattttcatagcataaaaattgttggtctcttatcagatgactcgatttatcttgttgcctgttgggcgacctttttttctactgcatggagtgaaagtaattgaataaagtcgattttcgggagcgtgaacttattgagtatctagaagaatatcgccgcaaaatgtatattgcatctacgaagtagaatttcatgcagtcaatttaagaaatttcatctaccatgtgtaagatatgcttttctagcaccagttcggtaacatgttagatttgcattattagctcttcactttctacgttctgcaaaagcaagcaacttatgtattgaagcctactagaatctgaacataaatccatcagaccatcctttgacaattcggacatttggattcagagagcaggattacagtgaatatagttctcactgttgactagtttatcatacgtctatgaatatacgcagggctgggcagaactacaaagtgtccgacaaaaatgctgtttattgtttatttgctgcccattacggttaatctcgacaaccttaagattttgtggacgtctcagttgtccccaggccccgttttgctagtaatggccccttagacggtataatggctaatggggataagatataaactaccggcaatgctaaaaaccacttcatctttataagataaggccgctattcattcacgtattgtctttattggagagcttgagtgtatgcacaaaatcataaagattcaaacttgattcaaaagaaatggaactggggagggaatgaaccatccgcttctgaattcattttgaaaccaattacatattcttctacagagccaaatttatgggtcatcagtatgagtaacacatctcgcttttaggattaaaacagagttgaagtaaagggactaatcacttgataattattcatttggaacatgtagcaaacattgatcgctgcagctaaactttagtcaggttgtatggtgatggatggtcttagccgccaaagataatattctggtactgtaaagttcaaggttctgctaacttgtcctgcaagccatatcttgctaaaggatgttgtttgaaagtagaactagcgctttattacatctcttttagtaaagttgaactaaggcacatccaccactggcttccaagaatgtctgcaaactcaaaaaactttctgtttggaaaacataaattacccaagatacaatagcttataatttggactagattggaagctactggcaaaataattgccctcctgtcttgcttatgtgtgccctctttgttagtcattaggctattaggttcagataaaactccatctataccagtcacctcattttactccagaaataagtaataatactctaaatttcaagtacccaagttagaaagtaagtaagtaagaaagcaagtttccccttgtctttttatgttctataattgcacggtattgcgaaacaccaaagtttatctccttacaagatcacttgtattcgtttggttaatcctagatgaatctttttaaggcatcccagcctctcttataatttcattttccctgaaagaaggatacagagtagatagaagtatattctcaccttgcaataggagcgagcctcaaacaaacttactacacaatgcttacggcataaggtcgtgcccgacaaaaataatgacgcgaaaacatgttgccatccatataatgatcggcaaaaaaaaacttgacaatgccacctacttgaattaatctttccattgatttccaggttaccattcgaatatgaatccggctgtttccaatatagttttgtcacttgttatgatgcaagtgtctcgccagctggactttgagaacgagtcagtagtattttatgtgagggcggcatatgtgacaacaactttgatcgtcctgggaacgtacctgttcgtaagactgaaaatccagtcaaagaacgatttaacaaccctcaagtacgttgagcctgctaaccccctttcgggtcaaagtgaggagcaactacaaatcacgacggtaaaggattacgatttgaaacaggccaacagcgccattcgcagtgtcttcactggtgttgcaatgatgggtttcatgcatttatatatgaaatttacaaacccgctggtgatgcaaagtgtttcccctttaaaaagtctttttgagaataaaataattcaaatccatttattaaacaagccagccgtaggcgaccttaaaagacctttcaaagctgctcccggactttttggccaaggtgctactgatataaagaccgataagcagtcaattgataaggctgaagttagtggtagaggaggcttaaaagaggagtgagtagctactatatagaatcgtcgttagaatcaattacataagcgcttttgttgtatcgcgttattgtttcctaatttgttgttttgggtgtatataccgcaactgctgattgttccagatatgactgacattaatgtgaaatattctctacccggcatcatgcgataccttcaagagcaatttactgcaatggaacgcaatcgtattgtgaatgatttagaaatcaactctctacagtcgaaaattctagagctagaagggcaacgcaatgcactaaagatcatgaacaagaaactcctgacgaagttacagatactggaagacgcaatcgggaaagaatctgaccccaatgacgaaaccaaacatagtgatgatcttcatccgactgatttagatgatatgggagtcaaaaagtttgtcgaatcgaagaactttctcacaactgctacatgtgagattctgtacctattggattctcccaaaatggaacattcgaacaacttgatagatcatcatcatatcacattcaagggtaagcaagatctgaaaacaattttcaatcagcaagtttcgggcttgagacatgttagagttcttgggcacctagtattattatcggcatcatacgacgccaagtccatatttcaaatatgggattatactacgagtgaactgaaagtcacattgcctattgctggcgatgttgttgacattttcgcccactcagaatatgctttgattgtgggcgaatcgcagacgacagtattccaaaactactcattagtcaacatctttccagacctaaatgtcatagatttatttaacaaaaaggtgcttttacagtcaaacggatgtacttctgttgtagaaataagacagatattggaagaaggtacaagggagggagttgacattcctacgttttcaggattgcgtcaggcgcaattcttgaacgataatgagttgataattccagatcgagaacgagaccttgtcctatttaatttttctaatggagagcaacgagtagtatcgagcgttctcccctttggttggattaatcatggtggtttagtcgtcgttaaccagttggtggttgtgaggtttaccccttctgagttgctctactttcacacaggagtttcaacacaagcaaagaagactagtataccgggcctaattctgtttgcagtaaacgaacatcacaaagtagtagctgtcacgagtgataatcaactgttgcaataccaatactctagggagttggacaggcttgagttgatatcttcgtatagtagcactccagttaagcttgaccccgctagtcgactaatttacagcgaggatgcaatatttatctgcaataaaagtcagggaacattgtctgttatgttggtgtaacgcaactcatagtatggggaatgacttacaagacaattaacatggaacgggaactttggtttccattaaggaccaatgatatcgagggagatctttacaccgataaaagcggaaaccaagactttgacagaacatgacgaatcccaatacggaaataacatcctttttatccaaggagctgggtgattaatctagtgagtgtgagggttctttttttatacaactaggacacaggtatgagggcagcagttagttaggacggtcatagtaagtgcctttcatatcgtccaaatgtgagtctgtagcgatgagattgattagatcagaataccagcgaacgggtgaaatattaatttgggccccatatgcagtatggatttttcttgtcatattacaaacgagtcccgataaaaccgtatatatagaagtatttagacccagtaacttttcgtccgacacaaaaaacttcaatcaactaaccaacgaatcgtaatgaaattgttatcattagtatctattgctgctacaactgcgctagcaaaagctaaagccgtcccctacgccaaccctattgcctttgccgaggctctagctgctttatcccatggagctgaatatgcccaaaccatgggtgagatcgctatgatgttccctcccgacagagagtggtctgaggacactgaaaatgaagctccttgcggaacgtcagccggagtcggtaatagaacggatttcccgctggacgatggtttcgtcgcacttgttgcacagtcatcgagtgcttggtccgtggagttgaagatttcttacaatgagaatcctacctccaatggtgactttgacacttgggcgactggtaatgttaccaatcaaattgatataggccactcatgtttttatttgcctgaccagccttctgataaagttacaggagatgtggccaccatacagttattgtatatggctctcgaggaggatgatagaaatgtcactcactatgcttgttccgacattcaatttgtggaggagtcagtattcatggcaacaagttatgcaagaacatgtttcaacatcactgacaatgactactactcttattcaatctatgctccagacgacgaggagagtgcagcggttgagagcacagccgagagcagttcttcaactaatgctgctgctcaaggtatgattggtgtctctgttggaattcttggctctgccgcacttctagctgccagtttgctttaagtcattgtaatatatggttatagttgggcctgttcatatgaagaagttatgacatgtgtcagcatatgtactttgaaatactaatggtgtcttcataaagcaacacaatagggggcgcagcaagtcaagcatttcccttttccctgagattagcatattttgtactagctacttggacgatgggaaaagcatgttacaatgtaatgaaaaagctgagagttccgttcttctacctagaatataaaaatttaattctcatttgtggcataagtcggtgacccgaagaaatccacggtaattttgactcaattcaattgtgctgtcaactcatttccacgtagacatgtcaagcaagacgactgaccatagaccgtatatgtgttacactatagtattgtaaaaagcctactcctgagcggcatcgctctctgaagtaccaagatcttctattacgtgatttggtgtaaggttgtatggctctatcttgcccaacgaatctagaggaaaatactgctcctctactttgttcaattctttgaagatgacgtccaaacaaaccaagacttttattcctgagactcctgtagaattcaactcctctctattatcgcaacttgatggtgctactgaatccaactacgcaagagaacaatacgcagaggcctatatacaacagcgagttcataaggaattaaagaaaattgagtcggaaaaactgagcaatttggatgctatgctctacaattccctccaggaaagcgaaagtgttaagaatcaaatattgagcgttgaagcaataaatgaaaaattgagtcaggtctctaatgaattagatgatatcaaaattaatagacccgagaagctggagaaagtagctgtggcggagaaaaacttagccgactgcctaaaggacaatactggtaagcctttaaactgttggaaagaggttcagactttcaacaagttgttcgatcatgtttgatacgtatttctaaatagtcactgcagcccaaatgctttgtataacagtatcatggcactgtcactttcacctccaccggaaagctgttcaatcttgtcttttccaacaatagagacctcgctatcattaaacttccaccattgctctcccgtaatatcttcagaattctttacaaatgcttggtaatgcccagagtccgctgacgacccctgatgagttactacggaaactaattcatatagggacgatggattttcccctctgagaggatcgtaatcatcagggaaagctttcttgaaattccttgtccatttctcgttcatagcatataattcctgctgattcttctcagcgtaatctctggtagatacttctgcaatacgattatttaaccttgctttcttcaattcacgaccctcgtcttcattttctttttcgattttgtagagttcgtcacgtactttaatcttactctccctaacctcttcgtcgagcaaatccgcaagatcaagttggaagggaaactgcacctttcgtaaaatctttgactttttgctggtgtctcttctccaaaaaaatctcacaaagtgaatcgttagatacttggggagtcttgtaacccatttggaaatttcatactttgcatctcttcccaagctttggttattcttctccagcgtctccttgagattgttgattaaaccatccttgagaaaatttgtatttatactgatgtgacagttcaacttcagtgaatcttcgtatccaataactggagattcgtttgtttcaagacatctcgtggaggttttgaactccactctaaagaaactagcaaggtcagggtatttccgcaataaaacactcaatagctgcgagtaaagctcttctgcatcctgctgcttaaaaaagccttgatcatttcgttcgttgaattgtggaaactgagttctaagggtagccagtaagttaagtgggcgtatcccaacctccttgctagtcattctttgaaaaagctgatatagatgatttacaatgggttcgctacgagtctcagaatccaatctctcctttatttctttaatctcaaacattacctgaagggagctattcaggtaacaggtgtttcccaaatttacaagtccagatggctcattgtggtatccaataaagtgttcatcttcgtcgatgtcttcgatgaacttgggagcaggcattttattatcggtcacattgattttctctggtgtccctaaaaccatgacagactgaccttccttcagagaaaacttagataggtcgctatcatctttcacctgaccgcctttgagtaaaattttctgacgatcaggggggatgttagtcaacgagtaaatttgcagcttcaaagtaaggcccggctccttaagatcaatttccagtggatatactttcccagcattttttattgtcacttgaatcattagtaaagtctccaaagcgtagagttgtaaaacaggtaaaagaaaacgcattaatgcgcccttgctacagcgttgcatattcacttctgaagaaaaaaaatactaacctttcaaatgagacatcaggtgtagatttaggaacaaaggtcaataagaaaaggaacgtggttcgtgtataatatgtaataggtaggattgacaataggggtggcaatcgagcttaccagtttgaaatatagaacctaacaccagaggacgctggtatgattcttggttaatatggaaactctagcaaaatgaaaaatgctcatgacattaactaatgttatactttatatgcttaagagcgcagcaactccaaacaaagaatcaaataaaaggttgtgaagaccaaaccagctcaagaaaaaaagtaatttgggactaaacacagtccaaataaatagatgaaaccttaaattgaagcaggacattagaagactggaacctgccaccgagtaaaataacatgttaaacaatagtttcaaacgaatcagagattcaattggattgttctgggaagcagaattctttattaattgcaatgatcccaacgatgctacaattggcaaggaccaattggaaatgaaagttagtatccctaccggtatcacatcataacttcttaacccattaaacgaattggaaaggtcaattgaagagagagcattggtgtttcccatgcagaaaaatgaaaaattctgtaagagaaggttgtaggtgaacaaatatgaaggagaagctgaaggtcccaaaagacgacatactagcttttgaactagtatcacacatactagcaggcccatgttttccaattttgtctgattcaatagaaatagattgaatagagataacagcccaggaaagatatggcttgattttctatccaatacagatcgaagcaaagttaatgcggtcgttacagtataaatttcaaacgacaactgcaaaagtggggttacacagtccttccattcatctaatttgtagaaagctgtcacataattcaagatgaagcgcagtaagggggtgacctttaactgcccagctgctgagtaaaatccaatcagtttagccagcacacttgagagtgcttcaaaacatgaaacaattgttatgaaggttcgaaatccagttgactctttgttaaatgatctgttgatatcattcagaacaacacagtatgccagaataccaatcgaccaaatggatatgcttgaaccctgcaaaagagaagacgtcgtcacgacggatagaatattgaacttttgcccactataattccatgctctcattaaccggagaaatgccattatggcaaaaaaattccagtacttatgttgtactttgatgtctatgagcaagaagtagctgaatagagagaagagaacaatcaatccccaccaagtttggtgctcctcttccaccaaagatgatccatgcatcgtaaccgaataggtaaagatgaatagttgtataagcttgtcaacgttcgttttactttgaaaattgcaactgaaatcggccagtactaccagtgaacagagaagaaaaagaatgaaaccgaaatagatatcaaagtagttgtaatcagaatatgaactcatcagaaaatcttgggcagtattaataaatgcgtgaatggatgcttcttcttcgacttcaacgctgtgagcaaagagactagataataaatgaaagtcagagttgtcatcgtttgtttcattcagttcccttccgaatgcctcctcaagtatcctttttaactgataagcattctgaaaaagcagggactttctttcatgttcacagtaaagatttaggatttcaggaatcagcttgccaatgttatttttgggaatgggaatacccagcagacctgatagtgtagggacaaggtcgatttgttggatgatatccaagaactggtacgagttagtaatatcctcttgaggaacagtacgattggagtggaaagaaaactgctcactaataaaaactagtccagcagatgtttctcctgcggaagagcctccatgattcccagcatcgttcataccatgatcacccaagagtatcatcagtgtattagggttgttcagaaggtgcttgctgtatattgtttttacaacttcatccatttctttctgtttgggaggcatattgggagagtttgggccacccttatggccaatatgatccaagcccaaataatgtaggatcatacaatcccagtccttcgcgttctgcagttcgtaattcaaatgtctcgtcacattattatccacctcagtaaaatctgcaacgtaaaagcttgatgtgccatcaactttattgaaatattcgggaaacagcttagtccaagtatcatcaccaaacatgttcactttcgctccagatttccacaactgtttgacccaactgtcttgcttacttagtgaggatgattgatcgtcctctgctatattcaagatagcatctagaaaactcggtgtggaaccagtggtgatggcctttaacctggggagagtcactgtaggaggatttgaataggctgtatatcccagagccttgcctccattcagaagactatggacaaactccattgaagagtggttagaaaaaacgaaatcactcctcagtgcatcaacaaccataaatatgagtttatcaaatttagggtcaggcacttgataattttctatacaatgctgatcaccctccccctgtagtacagctttcacgggaaaaaaaccttttagaaaccaaatatatccgatacattgcactatgtagagtaccaacagcagataaatcttcatgcttacacaataagaaacaaataagttgtttatgagaatatgagagcggtgaaaagatagcactggagagacaaatccttccttacataccagctgtagatggcataattcgcgaataatgtagctgaaataaaactcaatgggtagcttaccccttgcaacaatatcttgcttcaatgcttcgtttccgcctgcgaaatttgctatcaaagaacgtcatacgactaaaccattcatcttctttcaaaccagaatttgtgccaggacctcctaaattacctaaaaaggaacaagaggaatttgaaaaattgcaaaaaatagcaaactcacaatcggctatcgaccagtacaataattcactaaaggatcacccttctaacatgcaggctgtctctgagggacgagcattttcagagcaacgtccaccaatcctaaaatccgatattggagctttctctccggagtacctcaagactgtggcagagtttgaaggtgaaaaaaatccagaaactggagaggtaggaggcccaaaacaagatcctctcagaagatcttctgaatggacatacaacgggcgaactattgatttttaaaatgttacgtatcgtatatgacattatgccctactgtccccctaaccgcattcaatcttcacacttagatcaaacgctcaagcagattcatgcaagtctaacacagccagtttatcattgaccaggcgtaactgcttagacaacaattgccgagcttcgcgtgatttctgctcatttctaattaattgttctttcatgtttttccagctgttgaattccagcggacggttacttgtgagtacttctttaaccgttgggattaaaagtgatgcatttgttttgtttttgttgtaggtctgtaatttcatttggaggtattccacttgattcactagaaacttaaactgtgattgaattccttgctctctattgacaactttggcctttattaaattcaattctctgaagtactccttctcagcagcagatattggtagcgacttcctagtggatgattctaaactgcacaaaagtgcggtcaacgaagactgaatagaggagcatctcgatttcattctttccagcctattggagtactgagtaaacatatatttcactgcagcagcgtgtgaatctagtttttttttgttttcataaagtctataatttgatctttgaattctttctgctgcaatgcgagtctatgcaaaagcatcaatgacagcttattgagtgcaaaaattcgatgcaacatctcatcaccaagtttttgcacctccatgagggtggcctcatcggaaacaaaagagccaacggaaatggttcgcaagtgctcagcattttttcgctttatagattccagaaaacgaaatacttcctgaaaaggtatgttcatgagagaatttttacgcaccgttgctattaatctttcaataggtttactgacttgctgacacaaaatgctttgcgaaggtgcaacaacaactgaggttggaatcgtgacacattctacagtttgcttcgttagtattatcgctttcttaccttcagcgaaaccagttaactgtgctacgccaaggacagtgtccgaaaaactggaaccgtccctatgccgcagctttgaaagcctgggttccctgttatcagcagttaacaaatggtaatcacgattctttatcaacactgagttaaatgaagggaacattagacatttggattgagttttaaagtgggcgatgacagtcaacaccgaaccattatgagagcctatgtcattcctaacattcttacttctccatttcatacacaaatctttttgttgtctcagaaccaaaatacttccattactccaggagctaactagaatcacttgatcctgtgagttaacgtggcaaatatcaataccgtcctctgtgtacagttcatcaggaaatttcgagatgatcaatggtccctgcaactccatggaattaatgagatctatgtttactggtatcacgtaatgcttctcaactaagccagtcgttttactaattttaaactcaacggggaacttttccttatttttcagcatttgtgaaacaagtttaagttgaacaagagcttcgatactatctggactactcttagctagttcaatagtttgatctgttagttgtttcaagaatgagagagaaacggacaaaatggtggggaaaaatggaaaaatagtgtacacatcaccaatctctgtgttaacatacaatgataaagagcccacagcattcacggatgatccaaaactaatagacgttgcatttaatgtgtcttggtaacccaaccctttgcattcaagtttttcattcaaaggaaagatatggaacgggatttcagacgataaatttatgtcaaatgatcgcacacagccatctgaagccaacacgacaacattcgactcagctttgctcacctcattaaataaaactttgcaaatatctgtagactcaaactttccaaccacttgcgatttagcatacaagataccatcagacgttgatgcaactgcttcactggtgggtagcgataccaacatcaaattcttagctccatgaagtgccattaaagttccagagttgttcaacaaagctttaaccggatcaaatcctatggtctctgataactgcagtagtttgtattgtgaagagtggacattgcaggttctaattgatctttgagttacaaggaagagttcgtcatcgttcctagaacaaagcaggtcaaaattcaaaatgctctcttcaagcagctgttccgatgaagcattaaacccaagatcttctgtaaacttgaatattggatggttgaggtccatagtattgtataagttggaaaagtgataaagacaagaggacgtaatagaatagaaggattacgtacagaggataaaggcttgggcgcgaattcagagaaaaatgaaattcataagggctgatttatgggatctcttatttactgttacatctacaactgcagtcaggaattgcacacacgaaatgtttggagaaccagtgttctgcatgccccgcatgcatcccgtggttgcaggtcaaacaatagctaaaccaattttggaactgggaatggtctttgttcatatctgctgtttggatagccaccgcaaaggaatcgtcttctggagctgcagctcctagagacaagaggcaaatggaacaatggggaaattgagaatgacagtgaaggcagcgcgtaccgctagctattggacgatggcaccgagtacattgcaaatatacctggcgtggtaccagtcctttagatgaagacgacgggaacaatgactttgatagtttggttctagcaacatcaaactgggcacggaccgagaaggctccccaactattcagaaccgttcgataagcatcgatccatgcgttggccctcttatccacaaagaaccggggacaaccatatgagcaaagcagggatgcagtttgcacatcggcggtacgatccacgtaagattgcagcagatccattcccgtcggtgtaattccagtcaaaacgaggccttctatttccccacgagcaatcaccgtcttagaaaccctatcaagaaacatatctaggtcatgatcaggaagaaatctgagggcaacgcctagccgctctcttagcggcagtgctgtttcactcaacacgtcccaccaatcattatccgcaacgaacgcaaaaatcactctcagataaggattctgcaattcggaagccatcctgcgacattggtccctccaaacggaagtaccactcaaagaatttgattgaagatatccagctattgcggctcctatcactcgagtttcttgagatggcgaacttgcaagaatctccactgccctggccacatcaccgtgaaacactgcccagcccgcagctttctcgtgcaatcctagctcaactaacctttccagtttctgatgaagttcttcaatcccaaaatcccagccagcaacgactaggcataggcggcgttgcgtttccttagcagattttaccttcacaccaatacctggctctcttttcgaaataataacgtgagctgcttctataaagtactcttgttctagaaaagctgggtgtaacctatgctgtgattttaatgcatcgatgccgatccagataccaagaactccttcatatgccaggtctacgccttctgttttcatggtaccattaaatacgttcgaattgttgattgccaaccatttccaaacatttcgtaaacctaaatcgtttggttttagttcctctaagatgacaatattggagcctgcatccgttgaatatcctctgatggtcctgtaacgcatcaaagtacaagcgtcgtccaatattaaagcatcagttgcagaatctgtagcatgttcaacaattgttcttgaattagcaggtctatcctccatttctgaagctttatcggcaacatcatctaatattgaatcttgggcatgtgctagtgcagtgttttcgatagctccaattcgtgtgtacataccttcactgcttgctaaagtgatgtcgttgaaacagctccacgttatagcctgagctggctcatgaagagacattcgaaagattgttccggattgccgcatgcatataatatccactccaaaatctgtatcttgtcttggagcgtaatcataggatacaacgcgatcatatgtagtagcaacatctaccactgatgctacgaacagttcattatcctcgtatcggtcaactgatctagaacacaaacgtgagccggtctgccacctacgaataagttcgccactgaaaagcgttgagaactcaccaggtcgcacagagctcaatctcaaacaagatgaaccagtagggattagcctcgaaaatgatagtaagggatactcagttatcaccgatccagctccagtactgtgtaactttcttcgatcccaaaatgccaaggtaccatcttcaccgctagatgtaaatatgtttgggttataagggtctctctgtataccagatgtacatcttgtcgccacctggagagaaacagcgtcggcacgtaaatctaactctctcagaaacttatacccacctgccaataatgcttcttgctcatgttgaataaattctgtgctcacaaccccctcattaggaaaaaattgtgacataggctgtgctgaaattcctcgactgctggcatgccgaatgtcccaaatctgaacactgtgatcttgtctagctttgtcgtaaccaacacttagtaagccaccagttgaactaatagcaacactgttgcaagggcgcagttgttttggcttaagcaaaatagctgacccagacgctccgtcaatcatgtcagtaatatgtgtgactccatctagttggccgacggcaactataccaaaatctcgtggagaataagttgcagtttgaatgttctcaaaatgagtgcgggttgatatttttcgaatctctgaatctgctgtctcatgaattgaaatctcttcaccgttgggatgaacacatacaaacgaattgatggggccattgttccatgtagtggctcttagaacaattcctgacatgtaaagattaattagtagccgactatacaaaaattccattcaaatcgcggttttctatctattcttgtcggaagtttgtttgtctctcttacaccaacaaagtacaataccttttacccatgccaaatgacacaaccgtatcaccttttgttacaatgcatcactcaaattctcctctgccaaaacttcttttccgatccacggcacaaacctgatatctgttgtttcgttggtatccatataatttgatcgaagaaagtctttgtctcccaatagatggtgttccagctttgaagcctctagataaaccgaaggagcaagtttcctccatcgattaaatcttcgcacaaaaatggtaaattttgtggtaaattctgatacagttttgaagtggtaactatctagatgatttaaaagatcattgaattgttgattctgtgaaagaagatatttttcagaagaattcagattgttcaaaacatgatttcgaatgatatatgtggctggaaaatttaggagctccatagtacccactctaaaatcaacagtccctaactgtaactcagacctcaaaactattctcatagcgagtttgctcagttgttgaacgtctctcttcaaaatgcttaacgattctatacgttctgaaatctccttagacgacatttgaccgtagtaatgtattggatctagtcttttaatcagggacagcccgtattttgcttgtcgtttaagcgcccagtaaccgcatagttcgtagatagtggccttgggagagtctacatggatgttaaaatcgtcaaagaaatgccctaatttatttgcaaacatttccggtgctatgtgagtccctgacgatgtcctccaagaaaaaacgtcaccttcttcagggcccaatagtgagacctgtcggctaaatccacgttggcaatatcgtcttgttcggcaaattccttgatccaaatctaactttccgtttgaaggtataggcgaatgcttgtcgcagtagctaactaagtagcgaggattgtttaggcacgcttgtaaccctttacttaaatccaaaaacaagcccgctcgcttggcgcatgtcacatggtacgcagtaaaacagttcttgttggaacactgaatacatgcgcctatcttaagcttgcaaataaagcatttgagcttccaacggcttcgaggaattaattgagtaccttcaatgggctccatgtatatcggattagcaaaatataactcgttgatccataatccacatattatgtgactccatgaacctgtatccgtctgtttgaaggcaccagtaacagacggacaaaactggcatctcttgggtgcacctttggctataatgcatcgcctacaaaaccagggcccttcaggaataaacgttattccatagcattcctgatgcactgctatgttacatccatcgcagaatataatcacattattgacatcgcagtcactctcattgcatactgcgcacggttgatcttctgcatatattccaatgccatcatctgatccatacttactatctcgaagcgtttctgaagcttgattagggggaagaagcttctctaaaaaaaaccactggaactcaaggtaagtcattgcaacctctaaaatctctagcgatacttttgaaagtcttgctccttttcttcgttcattgaggagtttaagatagcaataatcctgttcgtcaatatcgtaaaggacttcaaaacaattatcacagttagaaacacctttaacaagactattagtcttcatatttcctctcccatacaattcggcatgccttttttgtttacgaagatatccaagagttcgaaaatcagcgttgcggaccttggagtcatgcagcctagatttataccgcgtattcctaaacgaagggaatctcttcgtagatgcatccaaaaaaaaaccagatctagttgattggcgttgattttgtttaaaccttttggccagtattattcggagaggagctttctcatctaaatcgggataaaactccctgtaatcagtttcttccctaggtttatcgatgttgtataccattgtattattgtttgcaacttgctgggggacaagagacgagtgtgaacagtgtggtaatttctgaaatgcacgtagatattgcagagtaatgatattgatattgagaatcaatagttaatcaactggaaataagaatcaacaggaagctgtggtagtttcctgctcaaagtcaatatggcgtacttggtctctggaggtatagtggcctaccctattcgcggctttgatgttggtatccatggataatttgcagtaataggcagaaatatactccaaaccgaccaccttactgtcggtccaacaaagctgaccgaaaagtaagctaccccaccccaccctctttaagtagttcattcaaggaaaatattaaccgggacttcataagctcacccactccaaagatttttaattgatcagtaaacgaagctcctaaatggatgtcctaagttcttgcatttttttctcagtaattgaggccacttattcctgtcagtgataatcaaccattttgaatttcttatgcgataggaatatagcatttgagattaaaatacagaacattgcccataacaaacacccctctttgaattaaagcttaagtttgattttatttgtgcttgagattaaatgttttgggcacggaacgaaataccaagatttaagtttgaatagactatctgagctgcaaattctagcatagataataatgccagtattatataaggctatcatgaggaaaaccttagaatgtcacatcatacaatctagtctaacccacctatttctttatattttccagaacagagtgactagagagtcatctgcattctattatgaaagagctcgaaggtgtatgtatgtctttctacaaaacggcttttagacagctgcaattgagtgaacagaaggagttagagtttgggttgtggtccaattaagacaaacaaacaccatcacctgggagatatatgaagagaaaagaaagcaaatgcatttcattcaatgaagagccagtgactacaaacagtggcaaaactatatcaaatgtcgttcataacgtatagttagaatgcaagagagtgagattaatcctcaagtgtaagcgcgaacttccattacaaagtactacagcatccgcaattcatactgtccgccaattttagtttcgtcttcaaaattcttaccattctaagatggcacaagatgctccctttgatcttttcaccgatactaccaatgattcacatgaaagaaaatcttctataagctataatgatgatgattttgataagtttctaaatttcgaacaaattgacaacatgagcccgctacaagaagaccctaccgatactcatttgatgagcaaaatgatttcaggaggagaagcatttgaagaaccctttgacttgcaatctcagcaaaatctgcaccaggatttagaatcttttagttcttctgcaaaccagagctatcaaccacaagatcaatatggctttcaaggtagcaattttgacatagatacttccattgcaacctcttcgggaaattacaatgctggtctattgaattcacagtatttctcacctcgtatcaaaccaacggtaggtagacctgggactgcaatttcccctcttcccggaactctgtcaacacctcaggttacccagtcagcaactggtcacgcacctgtaagtcatggctctagtacaagtgaagctataaaaattgcatcacctccgtatgacttaggttctgatgcggggacttcgtttggcactccttttggcacttcgtttggggcagagtcttacaatagcctggataattcatacataaagtccccatcgttcaaaggaagcttgggatcacctgggactgcgcaaggctctctaagctcaaaaagtgctctgaatagagaagagaaaatgagacggagaagagaattccacaatgctgtggaacgtcggcggcgagaccttatcaaggaaaaaattaaagagttaggatcattaataccaccgccttttttgtacgatcgggcgggttcgaacaaggaacttaaagcaaacaagagtgtcattttgagcaagacccttcaatatatcgaaaagctgagtgagattaaagcatctcaagacatccgcctcaagcatcttcgtgaatgcattgacctttatgaaaacatcgacacgggtaataatttccttgacgttccgaactaacgtgataaaaagtcctccttttatgtgtccaagggtctgcagaccgcggttgcatgttaaggattgttctcgcgcgcaagtgtttcgttgtttttctgctttcttgataatgtccctagaggaacaattcatccatcaatttaaagattggaaaaagaaaaacggtctattactatccaacaacaagtatcatctgcaatctaaattttaccaacacttacctacttttggtacagaaaatggggagacttttgtccctttatatagggagcaagcatcggaagaacatcagaatgccggggcttctaatgagccaaattcaacaacagtagatgcaattccttgccctacagaattgaagctaccttccatgacacgtgtggccggctttttgggagcacaagttgctgcaatactatgctttatcatcgccttttatgagttgatacattcgtttagtgcgaaaagttttgctttgttgtggagcagcggattaatactcttcgttttcagtttcactttattgcagggcccaagagcttacattcaccacttattatcttggaagcgagcaccgactactgcgatatttctaggtagcttattgtcaactttctacagtgctgtggtggttaagtcgagtgttttaaccttccttagtggaatggctgaagtcttctgcctggtatactatgtagcaagttactttcaatatagcggacagcgtctgctgatgtttatggccatggaggctcgacagttggtggggttggtgtaaataaataagatcatcaatatcatctctcatgtcagagcattttttggtcctcgttatttttcacataatcaacaacttctagaatggagcctgctactactattagcaaggcttccttttaagccttttttaaatctccacattaagaacgatagttgaactcgcgacgcgagccccgcctttaaagagaatgatagatacactcacattggctcacatggaggaacagatactccactcttcctttttttccaaagtttagtaagtcaactaattattttatttcaatcactatatacttgaatcaaatggctacggaggcttcctgtattttttgcaaaatcatcaaaaatgaaattccctctttcaagttgattgagacagaaacagtatattcatttcttgatattcagcctactactgttggtcacttgttggttgtcccaaagtaccatggtgctaagctccacaacgtaccagatgcatatctgaaggatattcttcctgtgacgaagaaattggctgttagtctgggtcttgatgtggattctcctcttggagctggctacaatgtcttacagaacaatggccgcatagctcatcaagaggttgatcatgttcactttcacttgatccctaaacgtgattcagtcacggggctgggagttggatggcctgctaagcaagctgatatgaaagatcttgctgcattgcacgaagaattggttcgaaaactaggtgataagtagttgctaggcgagatatagaaatacttaacgtgagttttgatgcaagactgaatagattcaactatcgcattgagggtttacgacgctaattaacatcattatacccttcctttcttgttctaagggttgtctctccttgttcaaggtgacctttatgactagaaattcagtttgttgctgtgtatcgactcttgatattccatcatgaaattgatataaagtacgaattggtatctgcgtagactaatggtattctcagaggtagtaagatagtagatagtgaaccactctggtctccaatttcaaattggtcgtgtgccaaacactattgccactcaaataagatatgataagtatataaatcagtccaaatcccttaacactgtccccaattagtcatggtcaacgaaaagaaacctttattggatgcttcaggcacagaaaatggccccgaagatcttactgccactgcaattcttcgtaaaaagaagaaagacaatgcgctgatagttgacgatgccatcagcgatgacaactctgtaattggaatgtctagcaataccatggaacttttgcagttgttccgtggcgatacagtcttagtgaaaggtaagaagcgtaaggatactgtgctaattgttttagcagatgacgatattgaagatggcgcttgccgtgtgaatcgagttgttagaaataacttacgtgttagattgggggacattgtaaccgttcacccttgccctgacatcaagtatgcctctagaatttctgttttgccgattgctgatactattgagggtcttactggttcactgtttgatgtataccttaagccatattttgttgaagcttacagacccgtgcgaaaaggtgacactttcacagttcgtggaggtatgcgccaggttgaattcaaggttatggatgtagagcctgatcaatatgcaattgttgctcaggatactgtcattcactccgaaggtgagcctttgaacagagaagacgaggagaataacattaatgaagtaggttatgatgacattggtggctgccgcaagcaaatggctcaaattcgtgaattagtggagttacctctgcgtcaccctcaattattcaaggcaattggaataaagccccctaagggaattctgatgtacgggcctcctggtacgggtaagacgttaatggcgcgtgcagtggccaatgagacaggtgcctttttctttcttatcaatgggcctgaaatcatgtcaaagatggctggagagtcagagtctaacttgcgttctgcctttgaagaggctgagaagaacgcgccgtcaatcatttttattgacgagattgattccattgcccccaagagagacaaaaccaatggggaggtagagcgtagggttgtgtcgcaactattaacactgatggatggtatgaaggcgcgttccaatattgtggtgattgctgctaccaatagaccaaattcaattgatcctgcgctaagacgatttggtagatttgaccgagaagtcgacattggtatacccgatgtcactggtcgattagaatgtcttagaattcatacaaaaaacatgaagcttgcggaagatattgatcttgaatctatcgcacaagagacacacggctatgttggtgcagatattgcatcgctttgctcagaagctgctatgcaacagattcgagaaaagatggatttgattgatcttgatgaggatacaattgacgcagaagtgttggactcattaggtgttaccatggaaaacttcagatttgctttaggcaactctaacccttcagcactgcgtgagacagttgttgaaagcgttaacgtaacctgggacgacattggaggtttagatagtataaagaatgagctgaaggaaactgtggagtatcccgttcttcatcctgatcagtttgccaagtttggtctgtctccttccaagggtgtattattcttcggccctcccggtacggggaaaacattgttggctaaagctgtagcaactgaagtttctgcaaatttcatctctgttaaggggccagaacttttgagcatgtactttggtgagtctgagtcgaacattcgtgacatctttgataaagctcgcgccgcagcacctactgttgtatttcttgacgaattagattctatagccaaagccagaggtaattcattaggagacgcaggcggagcatctgatcgagttgttaatcaattactgactgagatggatggtatgaacgcaaagaagaacgtttttattattggggccactaatagacctgaccagatcgatcctgccattttaagacctggtcgattggatcagcttatttatgtgccattaccagatgaaccagctaggctgtccattcttcaggcgcagttgcgaaagtcaccaattgaaccaggattggatcttcaggagattgctaagatcactaaagggttttcaggagcagatctctcctatattgctcagagagcagccaaattcgcaattaaagactccattgacgcccaaaagcgactactcgaagagaaagctactcacaaactagaatctagcgaagatatcgagatgaccgaggctaagcaggacggcgaagaggtagacgatcccgtacctttcatatcacatattcacttccaagaagctatgaaaacggctaagagatcggtcagcgatgctgaacttagaaggtatgaagcatatgcgcaacagcttcagtcatcacgtggccaatttacagacttcaagttcaacgacttaggagaatctgctggcaatggcggttctattggtgctgaatccagtgggcccgctttcggtaacgttgagcccgatgatgacgatttgtatagttgatgcgttcaatcaaagtctgaactcaactcgatgcggctgacccgttagataggtaaatataagaagtacatatattgctttatcacgcttcacgtagccagttctctagatattaagtgttcacatttcggtcgaagctccgattcgtgagttgaagagagtatacttttggagtttgtgagtgccattctggccgataacttaagtggtctaagatttaattcatgacaaaagtctcccccctcagtagtagatgtataagttacaactgaattggtagaggtggaagaaatcagagacgggatggagctgacggagcagtaagcagttttggagtgtccggagttttgtgaaggggatttgtccaccgttaaagatggcgcaaacttagtaatccgtgcatttttagactctctcaaactgtatgtgataggactcaaaaagggagcaagaatgttcaggagatcattggtgtgaattcggagatcccagttaaaatacccaagcaattctctttctaacgtgttgacatcgtctagcgataacaacccatcagtataggaagcccaatgatgattcaaaggtgaactgtcgttcaaggtcttggcagccacaataagacatcctaagaatattctatgatgggtgctagcatggatacctgttgcactaggaggaaggacgcctctcagcttgactaagaaatataatgtggacattagtgtgttagtctggacgttcgagtgaaggattaatgaattgataaacgtctttaaagggacagttgccaggttttttattgaatatgtttcttgtttaagtcgaattacgctttctgtagtaaccaccaagtagtccaccatcgacatcgaaaccgggcttcgaagaaatatactaagagcttccctgtcagacattaataatgaagaaatatgttttgaggtgcttgaatggaactgttgaagcaatatatagtcccccttcagtaggagtctcctattaaggcaaatatttcacaggagtataaacgcgtctggtgtggggtgtagggatgtattcttgaaatgctcctgctagaatattgcaaaggttaacgcgatccaataaaactcaaaatagccttaaccatcaaagtgacttatatcaatataatgcacagtgttgtctcagagacaaaaaaacttcttgattagagccaatgctggactaaaccgacaaaatcctgtctttttgtcttgggtctcaccaagcatcttcaatgctgacgcaggccaagtcacgtgatatccttcttactttttccttatcagtgtaaaatgcgtttcgtaaggtactataagaaggaaagggtccccaatttggagtcatgcagacatgtcctgcagaacattcctcacacctataaaatgaggcccagtcaagcatagtaataatttctgaaagacgaccatgtaatgaggctagatcaaacgacgtcagattcctggtttctttgtgcattgcaagaccgcgatgcgtatcaaataaaaatgtgacaacatgttctacgactacccgcaaagcactatgaattaaaacctctgaatcagagtgtataggaaagattggtatagtcaagtcatcaaccgcactttctattgcctgtttatatctgatatcaagttcttctacagagctgtccagataccgtatcgcgtggttgcccaatagaagatatgcacgattggcaaattcagctatgttggtttcagctgccgtatagttttgtaatgataaaagaaagggcgtatacttatccatgcaacgaccgataagggccttccagtcgtttgctggagttttcgtatccttttttggcattttcagtgccttgtggacttcttgtctcatagatcgaattaatttcggagaggaatccagcaaacgtcgcttatatgcgtctatcgcaaaggattgtcgattgataggagttatcaaagacaataagtcaatctcaagaggtatgaatccgtgatctctagttgccaccgctaagtgttcgtagttctttagctttaatagggtggccgtatcggaaactgaaaggcctgatgtttcagagatatactgaagggagacgttgctataaatatggtattcctgtaagttgcaaagaataacctcaaagtcagcctccattctgataattccatcaatatcgtagatttcgcaaatctctcgagctaaaatctcctcgttaactatttcagaaagattgcggccagcaagaagcaattgagaatccatattgccagccgtagtttttgcagcagagtttccgtccaaaagcagcaggcgattaaggtctcgagtcagcttcaacgaaagcagtcgtctgtctccaaaacatagtggtgtcacggagttgaatgtggtgccagatccaaaatcaacatctctctttttcataccacttcctctaacgggtcggaagttataggagacctcataattaaacgcatagtactcaggggacgcaagatcggtggtattacagctggtatgataaagcgtggtacctttgggcaaagacgcaagaaccatagacataccgtttgggtgaatacttgagcctttaacatcaaaaagatcgtgaatcatattgaaaataatagaagcattacccaagtccatctcaacagtacttttcagtcgatacggcagaaggggcgctgaattttcttgcgtagcagaaaacatagtttgtgactgaatatcccatactaaaagtaaaatgactagaatttgagccgttataacgatcgaaatcttatgactactggaaagccagtcattaaacataaggagtgttatcaggtccgtaaatgtaaactgtggtaaaatgtttgggtttgggctatatatatctgatcccttaaagtcgagcgtaaaaggaaggtcgaagtacgaacaaaaaaaaaaaaatgtgtgccacacagtatacgggagctaaaaagtgctctacaaaatcaattacgagcccagtgtatccggatagtacacaaatgctagtgcaataattaggtaggtgctcagcaacattgcaccctctagccaattcgattctccgtctaaaatcaaataatttgttatcaacactgctacgaacatgactgcagtttcaaacgttgaaaaaaacagagacatctgtgtaccactcacccaaccgactagcaccataaacggggtaacaaatagggagatttgaagagacgagcctacagctacaccaactgcgagatccatcttgtctttataggccacgacaacggcagtaaagtgctccgcagcatttccgacgataggtatcacaattagaccaatgaaagttttggagactccggtagaggccacaatgtcgtcgatagatccaactaatttatctgcagatatgctcaccaataacgtcgctagcaacaaagtggttagcgcccacttaacttctagtggcttttcttggagagacatttcggataaggcgtcatcttccctaccttctgcctcttgaaatagccgcttgtgagttttcagttggaaaacaagaaagaacacatacattagcagcaggatgagtgccgatcctcgcgataattttaggatttgatcttcattgtatgctgttctaggtaacgaagcgtgaaaagcagcaggtagtaacagaccaatcatcgaaagagccaaaagagatgacattgtttgagctaccgtttgattgaacctctgctgctctcggttgtagccaccggcaacaaagcaacaaccaagaaccaaaagaagattcgacagaatactcccaagcatcgatgcttgaacaactcgaatttgattttggcgaatagcaattagtgatacaatcagttctattgcattgccaaatgttgcattcaaaaggcctcccaaagtttgccctacccgttcactcagttgttcagtagaatatgaaagaatagcggccaagggaatgatcacaaggaaattgaaggagaacacccataaagcagaccatcctaagtaatcaacaagcaatccaaatgggaacagaaaaaggagaatgttcaagggtgaacaatataagactctttttaacgttgatcttgatcttaatgatggttgtagcaacgtctcattttcggattgatcgtaaaccattgggaagtaaatttggaaggtgtagaaaagtaaagctaaacaaggctcgaatcttctgtgcctctagttctactgttcacgtgctctttactttgaacgttttatcccatgtttagtgaagaaaaactcctggcattcgcgaaaagtgatacttttgagtgaaatcttattgtcaaagtgaactgtaacggtagagtttcttgatagcgtagcgtatccatctatcaatagagtaggagtgaaagatactttactctttcgtttggaactctaactgatagtgtctctctttcgaatattggaatagagtacaactaaattggcctttaaccgaggtatcaggttgcaccaggatatggtctaatcaagacaaagtttcagaaccccccaccgtagtttaagcagctataattgaaaaattactgacacttatatttctacataagtcaaagaatttgaattcttgaacaagcagccacatcactctaccgcgcaccagctcaatctctttgtagtagtcttcgattccaatacttcgactgcaagttgttggacattctttaactgatatggtgctagtatcttaaaattacctttcgagatctgggataactggtaattaggaacaagcattatgcctttgcgaaatagatcttccgccttcaagtcattcgttatatactcgtctgcaacagatttgtagttcttattcatcacaagaagtttgttgacatgccttagcattgcgcattgaagcaaaagcaagaccccgtgtattgtttggtcactggtcttggtctgcaggaagtgtgcataagtaaccatttcttgccagttgtctcctaagatgtcatcggagtaggctcggctaaagagtagtaatgcatcaagaccaaccaaaacaccttccacgagttcagatgaaccttttaataacttcaggtcactttgatgccggcacaactgggcgagtttcgtatagttaactctgatcttgcactccagaacgggaataggattgactttttgcttccgagaaacgatttgctctctcttcgtctggcttttcactttatatcgcacggaatcaatggatggaactcctaaagctcctaacttcgatgatttgctagccatgactctgtgggacattttcttgcatctcgtttgtaacctgtctgttcctacactaagtttatgagaggctactttggattctagcctcggtggtaaagtgggagataacaacggcataaggcaagaaccagaagtaccataacggtctggtaaagttggtgataacttaattggaagagtgtaagtaagacgtggcttgtaataaggctttccatcaaaaaggttctccgggttggagtttgtgaggctcacatctttgatcagtctttcaatataaattggtaacgttgatgacaatgccggaggtaatttctgtagttgttgatatacgcagataacagattcaaatctccattggttttcatcattgtggcttaaattagatctgaacatggtagtatttaaaaatggatctctttgcagatttactcaatatagcgaaaaaaggagacattcgttacaaaatatgaagataattcgcctcataactcgattaatcaaaacagacggtccagttcttcttttggtagtatgtcagaatggccctcagctttggaaaattttgtaagtcattgtttccagcgtgccaacattgagagctttccacccggcaaaaaaaaagaactccaaaaacagttgacgcaaatcatcaatttagcaattcttgaaaacaaacttaattctaataactggtccaaacaaaagctaccaatatttggagaagcaagagagttagaattggagcagaaaatgggaaatgtttatccaattactgtttctagtcgaagaagtgacttgatgcatcaagaggcagttcaaccatctgagcctttagttccctccgaaagccaacaaaagaaaaagtctagagaattgcgatttaagatcactaaaaaaagttctgtatcacccgcaaataaaatacaagttgcttgtgacttgaattgtaaacttgtgggaactaacacctctatcgagaaagattattatagacttacatctcatccggatccttccatggtaagacctttgcctattttaaagaaatcgttgcagcatctttacgccaaatatcaaagtctagaacgtttcaaagctctcagcaaggcagagtacagctattttttgaatcaactgaaatccctaaggcaagacctcacagtgcaagacattcagaatcagttcactgttaaagtttacgaatttaatactcaattggcgattcaaaatgaagattttggtgagcttaatcaatgtttgactcagctggcgcaattgtacactgtatcaactatgggtcatacttattactattctgatactggcaaatacaaccaagagcacaactgttttcttgccaaggatctttgtgaggatcgaaaccatatcaatatgttcaaatttacgagttatagaattttatattttcttctcatagacgccccctgggaattgctaaaaataaggcaggatttattcaaccgtggtcaacagtatgcaattcgtcacaacaaatttcttttgaagtcattcaagctttcggatctcataaccgccatggattatattcatatcaaggacgaatattcattcctcgtgaatatggactcagatgtctgcaatttaaggacagtgtttgatgacgaacatatgactttgaaccaagacgactggtttttctataagatactctaccataagattttcttacgagaacagctgaaggccctgataactataagcaaatcttatcgacagatatccctctactacttgaaaaatctactgatggatttagtattcttggaaaagaataagttatctcgtttcattgagaatggtgaggtatttaactgcacgagcgcaagatcattactgcttcaaatagagaagaagcagctatcaaagatagatatcaagggtcaggtatgagcaataaaggaacaaataaaaacctgttttgttcatagaccctattagacgattttacatctctctttcggcagttttctctcaacttatctcttttcagggatcttgcttgtaaaaagtttgatagaaagtgcttctccaaaaaacaacacccttttgacgatataatctcagctatttttatcactatgtgttcccttaaattggcgaaacaagggtgtcgataaacattatgaaatataacattgggcatcagtagacagcaatactcataaaaaacatcaataaaactgtcaagatcgccctcgtggagtgccaaaaacttgggcttcaagatttctagttgatgtaagagatagctccagagccatctgttaatcacagttgagtagtctatcggagatgacatcgcgtcgtttatactgggtaaagacgaaagtgagaccacggcgaatatgttactaattgactgatgaggaggcaagcggttcagggattctagtagtgaacgttgtactttatttaaaagttcacttattgcactttgacattgtagaatacggccaagcagaagggttctaagattgcagatttcaagctcttttgacttttgcacaaaagttctgaggtcagtgagtggactgatctcattttcataaatgccaaacaactgcaagtagtttgaaactaaccggttttcaggaggttcaatcagcggtaacttgtcgagagactcaagtgttgtgtcactgaaagggccaaatacttgttgggaagaagctgatagtgacaaatcaacatggtcaatattgcgaatcacaagctttgagtaatcatcaaaaaaaagttcactaattcgaagcaacaatgaattcggctgaattagcaaaaggtcaactagtgaagctgattcctcaaactgcgataaaatagttttgaaaaacgaaaataaaccaggaacagataactttgaggactgatcaatgtaggatttcaaaatgtcttcagagacatctcgaagccaaatgttgtataaagtatccacaccacccatctcagtgttaaaaaacgtggcatccgctaaaccgtggtgccgctcattgatggccgccaacgatgaatacaatttgtaattgagggtttggtctttcaccatattacagatttggattgtgcagactatgtaggcgaatttgtgtttaatatcaaatatggtcttcaaatagttgagtctttgatgaaaaaaccattgcatcaacgaagtgtaatctctaaatctgttcaagataatgacggagaccaatccaacttccaactccttaatatccctattttccttaacaatccgctccaacaataaagtgtccagcgagacaaatactcgcttcaattgagtattgaaaggtttacatgaatctaactcagtaccataagtattcagtataatgaaatacgtttcacaaaaatctaataagcttccggtattatctgaatttagcagcatgtattctaaccggtacaaccagttttttaaaagcaaattcctggtcctaccactgtgctttagcacaactcttggaatagatttatagtatgatttgatacagtagttattttctttgaagcagatagttgctatattatgatctaggtacacactactgttgttcaatttggctatctcgttggaaatgttgattagatctctgtacttttcggcaaccaaatatttcaattcagaatcatgttgttgaatttttttttccaattgaactaccacttggttgattgcagaaacattgagtttcttaaaaaggaggttgggcgacttttcatcaattagcgttgccggcaccataagcaggaagatggtggacctattcttgaaaataatccgagatagaacgcgaagaagaatttagtcttgtgcacgacttttctcaagtctctattatccgggtaaatattgcttttgctataatcaggagcttgattacaactctaaggtttactcccatcccttatatgattgattatctcctgattgaaaacaaagcacagttaaccaaccttttacgaagaaaaagtaatgcaagcagaagcaacaccaagcaccaagaaagggaacaatacctcagcaggcactaagttaagaaagtgcaaggaaatttctattccgcctcagcgacctctacctaatggaacaactgttaactttggcaacggcccagtaccaagttcgaaggatcccagcagtactatagggaacaagagaaacaaccgaaaaaagttatcaaaccagaagcaaacgtatgatgttatattcaattcagacttggctcaacaacaggttaagggccagcaagatcattcctcaattctgccttcatcagcctctcgtgggggtgaccaccgaactactcctaaatctagtaaagaactaggctccgcaagaccgaacagcctgaaacagggtcaaaatcaagcgaataagcagagtagggctcccagaattgccgctaaaccaaccaaatatgctggctcatcttttcaccagtctccgtccgccgtgtcgttaccgaagccaagctttctgtagtgaaagttaattgtaaatttaactaaatgttcttattatatttttattctactacttgtcgcaatcatcagattcacttggaagggttgtattttacattctagtatggttcttgacatttcaaatcataacccaaggaaataccgcagttcataatactgaacttatttgttacatacggatagacgatggactcgcagaggtcattggtaagaggaagcttttctaatcgatgaggattcaaaaaaaaaaaaatgcattctccaggacctcaacagggtgcgagtttctttatcattcggaatttatgaagaatattggctctttcacaagagatcgtgtagactctatggtctctgaatgttcttcagcttcatctattcatgatcagcttgtcaatgagaatgattacgctgtctttggtggtgttggaaatgcatcgattccatcgtcaatctcaagtttccactacacctatgtgaacaatggagacactgacgttccacttcaaagcttagacggaaatatcagaagagcttctagtatagaaaggaacagtcggaggagttcctccgttgatcttcaggatagagccaagttccgtttctttgatgttgatgatatacagaatgcccatggtagcagtaccatggatagtggcgaatttgaaatagactatgtcccatattggaatcaagaggatggtaaacatgaaaatgaaggccaacgaaggttcttgaatcaagcagaatcaagaacaacactagaagaaagggttcgacttttagctagtaatgatatgacctcggattacggttcgggatctcttgaaactcacagtgccaatccacctgaaaacaaaacagacgcaagtaaacatgacgtttatttcagcgatttccctgcaataacctcgttccagcgcttctacatcgcagaacaagatttggtagtagggattgcgggataccgttcaaatttttataagatttctggttgctacgttttctatgctataactttaggtttaggctaccttatccttcgatggttccctaagtatcaagtcagtttttcaggggatgcatgtcctttagccaaatccgactggtacgtcgtggaaacagagtatggagagttagagattttgaaacccaaacgtacatggtacaacaagcctctatctacatttttgaacttaaaggaaagcgagggggatgggcaaaccgatagttcgcaagacgtactagatgagttcgttggttcggagcatgatccaatagttccagttttgatcacgctaaattacagatatctgactctgatatattctccaatggaagacttatttaaaacaaatcgaaattggtctgatgactgttggaaaagtattgacttggtagagaacggtctatcttacgatgtggtgactgaacgccagacagtatttggacctaatagtcttgatattcaggaaaaatcagttggaggattattaatggacgaagtgttgcacccattttatatctttcagattttttctattattttgtggctgctggatgactactactattatgcctcttgcatatttatcatttcatctttaagcattattcagaccttgatagaaaccaagaaaactatgaaacggctgagagatatgtcacatagtgaatgtgaagttcgagtttggagaaatggtttttggaaagaaatcaactcaagagatttggttcctggagatattatggaggtcgatcagttcaattcgtttccttgtgacgctatcttgatttctggcagtatcatagtcaacgagtccatgttgacaggagaatcagttcccgttagcaagaaaccgatccctctagattgcatgcaagttttggttcatgaattgaaaaaccaaaaaatatcaagcacactttcccggtcttttttgtattgtggaactagaatagtcaaatcatcaagactgaaactggatcaacctgctatggctttggctgtaagaattggcttcaacaccacgaaaggttcattggtccgatcaatgcttttccctaaaccagttggattcaaattatacaatgactccttcaagtacattgggtttatggctctaactgctatgtttggcttcatttactcaattttgaacttcctcaaattacgactggatcgtggtgtcattattttaagggcgctggatataatcacaatcgtggtgcctccagctttgcccgcaaccctgacaattggcatttctatagcattgagccgtttgcaaaagaggaaggtattctgtatttcacctgcgaggataaatattgctggtcagctgaacattctctgtttcgataaaacagggactcttactgaggacggtcttggtatcttaggtgttcacgtagtttcttcagatgttaatttcggtgcgatgattaagactggcgacgagttgcacaggatgggaatcgaacgctcaaggaaaaattttttgctcttaacatcaatggcaacttgccattctttgcacaatgtggatgaagaactggtgggagaccctctcgatttcaagatgtttgagtttacgggctgcaaacttatagatgacatcaatgatccctttctgaaaaaatttcaaaaccaacttgaggagaacgtcactttgtgcaaaatagatgataccaaggaagtcattgtcttgaaacaattcgattttgtttctgatctaagaagaatgtcggtggttgtaacgctcttggatacagaagaatgtttttctcttgtgaaaggagcacctgaaattatcatcactttatgccgacaggaatcgctgccatcaaactatgaagagctactggaccattatacacataatggatacagggtgatcgctattgcagctaaaagattgtgtacttcgattgacgaattgcttttgaaaaacattctgaaaaaccgaagtattgttgaggcggagttggaatttctggggttcattatctttgaaaataagctaaagtcatctacgacatccaccctgcaattgttacatgaagccaatttgcggaccgtaatgtgtacaggtgacaatattttaaccgctattagtgttggtagagaatgtgagattcttcgttcaaaatccaaactatttgttccgcagttgattgagtctgaagagggcactgacggattggatgtcttatggagagatatcaatgactcagagagtattctagattcaactacactcgtccccttagagccaaattctgatgactaccagctagccgtaactggtgatgttttcaagtatcttttaacttctgattcaatatctgaatctaccctagagagaatgctaatcaagaccggagttttcgctagaatgtcccctgatgaaaagcatgaactagtggaacaattacaaaaattagattacagtgttggattttgcggagatggcgctaacgactgcggtgcattaaaagctgctgatatcggaatttcattgagtgaagcagaagcatctgtggccgcaccttttacatctcagaactttgagatttcgtgtgtgctagacgttatcaaagaagggagagcgtcattggtaaccagcttttcttgtttccagtttatgtcgttgtattctgcaattcagttcatcacggtgtcgattatgtatcaccgcggctctaacttgggggattttcagtttctttatattgatttgcttctgatccttcctttagcgatatttatgtcatggtctaagccatatcatttggtttcaaagaagaggccttctgcaaacttagtttccccaaaaattttgattagccttctagggaacattctcatactactagcattccaactcaccgtttggcgccttgttcagttgcaaccttggtacattcagccggtccccggaaacgatgatgatgtgcaatcttcagaaaactctgttttatttgagtattccaactatcagtatattttggtgtctgttgttttaactgctggtcctccttatagagaaccagtagatgacaacaaaccttacatttggaatgtcatgctcgcagcaatttgttcgactgtgataatgtttattccttccagttcttatttggggaatcttttgcaattaactgacatctctgtctcttttgctctctttattgttgttttcggtggcatcaatttcattacattatacattgctaacaggatatttttcccatgcatctcacagtgctacaaaagatatttcagaaagggaaaaagttcaaaaaaattcaaaatcctggagaaagagttcaagtactgccaagtctaactatttctgtaaggtaaaagcgataacaaatatttttctgatgtcaccatttcgttcgcaagaagcgctcaacacagcttttgtaggcaaggtactgtctcatacagacatccttgttcatgttctgatagtgtttcgtgatgcaactcccatactcttgtgcctctagggggcattttgctgagatttcgacaaatttgtgagtactttgtttcagcgtcttgttccaagacatattgatgttgaaagtgatcggaaggcaagcaggaaaatgatacgctggaaaaccccaacaccactttatcaaccttattgtatcaatcaaatgttcccgaatatcgttacgtgtgaagtctgcattttatgtcgttgctggggcgattgctttagtcgtactctcctatgttcttttataatattcattctgctaggtaggaggaatagttttctctatctgggccgcaatttggtacctaaacactttatactacatcagctcattgaagctggctcaatttttcaaagattaagtcccttcagcgaggctatatatctcattatgtggcataatttttactctttcaagggctgtgcattaggaacacgtccagacgactcgaaatctgtagtcgcagtgtcgcttaatatagatgaatcagagatcccttcattatcattgagctttgaaacgtacttggcagtggaggtacgcgggggactatcttctttgaaccttggcataaatgctgtctctaactgttgattgtcaccagtaaaattattttcaaccttgcttgtatcttttggggtttgagacattttgctgataccaagcattgaatccagattgctaaaatcaatggtagagttcccggtgatctccctatatttcaaaagagcctgtccttccaacaattctgcatcattgtagacaactgaattctcttcattgtaggtgcgggcattattaaacatcaggtggatatcgttcatgaattcttccaaagaaacgtagactagtcgactgattcgcttcttgataacatcaaacgcaatggggtacttgattaaaatgtagtaatcgggataaagccgcttggggggtttcgtcaaaaagatgacactcaagttacgaccatctttcatatactgtaaaagatggttattgattgcagtgatattgtcctgcaactgttgtctctcacggttgtctaaaaccggtaatgtcgagaacaaatgtctagaaagagggacattgaagcctggcttcaattttcccttggtacgtccagcatcttttggcttgagagttcgaatttttgcgactttcataggcttattatcactcttatgtttcttgcggacatcgacgacattagtttcggcttccaagtcattcagttcacgctttgtgccaccttctgtaaatgtgaggccgtcatctgttgcctttcccttactttttcttccgggttcaggtccatcgttatcatcttcagaatcctctagctgacgtagccattgctcctccgtcatgttatcatcgtagtgcatcatcttgcgttccctgtttcctctaccataaatatcaatatcctcattcttctgcatgaacaagtcgggatcctggctgtaaacttcaggcaattccgcttcagtgaagagcctgggcaaaatcttcgtctcttctactctatccttgtccaattgttggaattttcttagttcagtatcatctctagctaataactgatttagctcgtcatcatccatatcgtcatcgaattcagagtccgattttttactctctccagcttctaacaattgcctcaaaatagcttcttgttcttctgcagtagatttgttatcaaatcgacctgcttgaataacttttccgtcaatatccaacttttcatacgccttactcaagatgacttcctcaatcgaatcttctgtaattaaccgaagaatccgcacctcattcttttggccaatacgatgagctctatcttgagcttgtaagtcctgatgaggattccaatcactgtcgaaaataataacggtatctgcagtctgcaagttcaaacccaagccaccagctcttgtagataacaaaaatgcaaagtaatctgagccttcagcattgaacagtcgtaacatgtcctgtctgtcatcagacttggtcgctccatctaatcttagatatttcatatccctgagcctcaaaaagtcttccatgatatccataatctgagtcatttgaaagaaaattagtactctgtgcccagtggccttaaacttgggcaaaattctgtcaagcaactcaaactttccactgacacgccagatattattattggtctctctggtgggatttatcaaattttctacttcttcgaaaacgaaaggatgattacagatctttctcagctgcataagcttgttatttaagccctttacaccaattggtttctttgattcatcgccaacaaagagttggttgtatttgagcatttgctcatacaatttaatctgcaaagctgacgatttgcatttgacgactttttcgattttttctggtaaatccttttcaacgtcttttttcaggcgcctcaataaaaacggtctcaatactttgtgcagtcttctaatgaccaaaagagtttcttcttccgataaggctattttatcatgagaaccagtatttgcaaaaggggtattgaaccattcatcaaaagatttcacagaattgaaaattttgggtaaaacaaagtttaaaagtgcccaaagttcaggaaggctattttgaagtggtgtccccgtaagaattagcctataatccgagtgatagtactgggttaaagttgacgatagtttgctattggcattcttcattctatgcccttcatcgattatcatatgcacccatttcactttgctcagtaaaggcctatccttaatgatgtactcataggtggtcagcagaacctgaaactttttcgccctaatatcagcctgaacagttttcctgaactggggattgcccttgtaggttattttctttagcgaaggagcccatttgtcaaactcagaattccaattggttaacgtcgacaaaggaacgatcactaaaaaggggcccggtatgttttttttctctactaaataagtgagcaaagaaatggtctgaatcgtcttgcctagacccatttcatcagctaaaataccattcagtttgttattaaacagtgataccatccattgcaaacctttcacctggtattcttttagaacccctcccaccaatatcgttggctgtttggtaatttcttccttaattttatgagcaatgctataatagtcggtgcttgagtcgttattgtcttttgcgtcaagattgtcatccatatatgtagatccccctccgagaaaaagtttagattcttgttgttggtcttttactgcctgggccaaagagtccagaaaactgtttgtctgctttagaagatgtgtaattcttgcatctttcgtctgatccaataacttgatgtaggtttcctcatcattagcttttaaagcttgcagccgttgcctagcattcttttctatccttttttgctcatctctttcgactaacgaatgaaaatgatatataagttttcccatcttggaacgtctttctttcatagtcattctacaatcctttagatatttggaggattcgatgatattatctagctttttgatctgtttggtttgctccatctgcacagcaagagactgttgctgaacatacaagttgttcgtaaccacagcatcatcaatagatactttccgagttttagaaagaaaattaggatggttgttgattagtaaagagttttgatgatgggtaatggatagaatgtggcctctcaaggccttctggagaggaagtagcatgatggcatcaagttcaagctccaaacctctcaaagcagtttcattatgaaaattcgattccattcgcattttctctaatgagtccttataatagtcaatgctcaagctatgaagaaggtcatatgtttctcttgcagcagatgtgttgatcactggaggatggacacttggtaataacatgcttgacctgtggcttgctaaagattcgaatggaatcgagcccttcggaggggcaaacgggacagtaaaactgtctactttcacagtgggatcatgcacttgcacaatattcaaaactgtgggcagttttttttgtgagttcagatatagatacaggtggagtgtctggaggaaacattttcaggatcaagggtgtagaagtgtttgccactctagcaacctcttgacccgattgtggaatgagttgtgttgtcatttgagaattgggaaattgtggtgacgatatgttaggctgtgtttgtatgtgtttctgctggagaagatatggttgcttaggagttttgcttgcagtaagtgatgaatcccttttccctttaaatcccacgctcttatcagtctgagagcctttaccaattgatgctggatggccgacaggtgcctgggaataattttgcaattgactaacattctgtggcaaattctgggatatcgattgttgcatcgattggttaaaaccgtgctccttgaatgcatcctgagaatgctctaaatctgttttgacacctctagactttgtattctccactggtgtattgactcgttgcttcagttgattataggcagtcgaaagaacttgtcgcacctcaggaggcagctgttgattctttgctaatccccggaatgcggtaagctgcgccttcaaaagaaacgattgctgtgaattgaaaattgtagtcgcattcatactgctagtagctacttgaggttgcttttgctcttgctggtggtcttggtcctgccgtatagtgttataattttggccagaaaaagtttcgggtggcagttgattattgggcaaatacgcttgtaaaggattaacaacagaggaggcactttgggtctggtcataggcagtggagtgtatatcagaagatgtagtacttgagaaccgcttttcttgctcttggacatgaggtaatacatcagagaaacttggctcttgcattgaaaactgtgaccctggctgaactggtttttcggatttattggtcagtacttgttgcattgaatgatcgaggtcctctggtttttctaggtggtctaattgatctgatagttcagattgctcaacttgttcctccttttgtgtttgtccttggcccaaattgtgctcttgctgccgctccagaaagcgatgtgtaccttctccatatgattggtcaactatatgagactcttgctgatttgttgtgttgtccttgtttttggctgcgaacgtcaagtacttggtcaactgtatatattctgggtaactagttgcctgttggccatattgctgattcatttgaagccagcgctaaaagatacatgttaatattcgaatggttaaaaaaataattcagaaaaaatacgaacattgtaagcctgattcacttctgaggttaattgttcacggtccatttgttgctagataagacttggctatgacaatactgtatgtatactctgacaaatggcaaattgtctgtgcactacaactcaatattgattacgtaagttaagctcatatagctataatattacaatgccagaaattttgtagctgtagctacagacagtaaaatctttcagctcaaaggacaatgaaatgtgtcacatgctatcgggttcctggtacgctggcaagtcctcttcttctatacctgctgatcttcctgcttcaataaataacgtttcaaactccttaacaaactcaacaaaacctccctcattgaatacaatctccagcgaacaatgatgtgtctgatttgaagctagaggcaacccacattccaaaggattgactactataaagctgcatctccatctggtaggcccaatccatggagttactaattcagattgagtgatagtcctatacggcaaattaaaactttgaaagtcgccacctcgtagagcacttgttatcatcagaactcttttattggtgacgtaaacgtttcctacggctttgaggaaatttcgtctcatcaaagagtgtggaattgtaatttgtaaactagtcctatctggtgaacgataaactaccagttcgcctggaagcggaataaacggcaaactgctgtcattagacgtatcagatgtcatgctatcatttaggatcacacagttcagagacattacttacttttgccctggaattgttggaacctagaagagaacgatctagcacggtggtactagttatcactgtgcacgcagtcgcttccgcgaagtgaggaacagtagttccaagaactagatgaagctacagactggatattggccttccagtattgagatccaacggaaattaagctagtacatttccaagaggaaagaagggtccataaaaactgaagcgtttcgatactcaactgttgaaactatacttgtatcgtctagaataaatcttccatgtcatcatcgtcatcttcatccccatcctcatcatcatcctcatcctcatcctcatccaattctctttgttgatatatattatgggatgtgacattgctgttattttgttgttctttttgttccatctcaacttgtctcagtttggtttcaagttctgcctttagcctaccgatcacatcagagattctgttcttcattatcggattgcttgctttgttaaaatcactctgtttcaagccaatcgtagcctgtaactcctcaatttcttccttaataatttgagtgtgtgtgagtctctcatcgattccagctctctggccagagataatttcctttcctccaacgacttcttcatcgtcgtcatcttcatcgtcttctgtctcttctgtttcctcttctgcttcttcttctccctcttctacttttgcttctgcagagcacacccgcttcagctcaaaagtctcttcatcctcgtcatcctcctcctcctgctcgtagaaacgaacgtgggcatcgctgtcattcgtctttcggcctcccttcgaccgctgttgaggattcaacggtgtgtctgactgctgctgaaatgcttgttctagctctagttctaagtcttcattgtcttctacatcaaggtggccccttacagtaaattcctttgtattcggtgtactagcatctgcgtcaaaggaaggaatcgtaccggcctccgtatcaactagctcgtacttactggcttcagcttcctcgtctaaacgaaacaattcatccacctgctcttcgataatttgaaaaactttactggtcattctcttatcaaaacgtttctttacgcctcgcaaaggaggtgtcaatccatcatcaaacgtttcgctagccgtcagttgaatatccaagtattcagattcgtatttcagttccttgatgacaagtagaatctgcgagacatccatggtcttgaatatattctttctgtcaatcgttttatggatttctaccattgttggcaagtccaccaatttggccccatataatctgtctttcaatcgcaagacagctcttctcttatctttccactgaaggctgatctcactaaaatctccctgctccacacactttttgacatattctaaagagtagtcgttaggtactatacgcatcactatggcctcttcggtggtaggatcatcctccctgtctggatcctctgagtcatatccatctcctgctattcttgttggcttgaccctaattctaggaataactgtagactcaggtttatttattggaggttttaccttgatctttggccttctttctactgtattctgtttcttgtctgtgtgcagcttgagtttaatcatacttaatcgtgcgaggatgatcaaaaagaatactatttgaactcaatgttctaaatcgcgcccataaactgttcttgctttgatctatatctatacaatgtccaagtggaccaagtttttcaaagatcagactttgaattattactatggctttaaatatttagcctacagtgaaagcttgaattctaagattatcaaaaaactacgtttaaatgaaacttacgatcctaataggttttatctgctggacctatatccaactaggggaacgatgtccctcagtttaaaccaaatgttacttcctattagacatgtactgatggataatcacaataaatatcaggacctattgcagtctttgaaggaggcatactgtcgaggagactcaatggtagtttctaggaaagaccccttttcatgggaatcctacctggaactgatagacgatgaacaagtgatttcaccgagaatagaaaaagaaagcaaatcagtcaacaaaagtttactggttcatgctaatttgtcgaatgatgcgggatatggactacttgtacaatggcttggatgttgtgcccgtagaaattggcttcagaagtatgggaatgttagaatgctgatttgggtaactgcgtccactgctagtcacttgcttacggaaataggatcatcgaaacgtcgaagaaacgcattgaacatggaggcatttacaaactccactttagtagctatttccgaaagctcaaggaaagttattggtgaggacatttttagcaagtatgctccattggtttttgatgacaaattagtctgccattctgtttcgcatgatagtgacctggcactcatagatatacagccgtccaacaacattgtgactgccgaacaaacagcagcgcaaatcgtggacctagatgtttgggaatacgtcgtcaagcagctttttattcagcctagattaactatggaatataatataccaatgttagcagctggggcaggagattttattctccctcgtctgtctgcacgaactagaaacaagagcaccgttgacctaacaccaaacgatatgttggaaattgttaagctttttagtttatggcctttcaaacccgacattaagttagaatttgtagaagaagaattttaagactgagcagacagaatcgacaaaaggtaagaaatagaagaatggctacatacaaaatagcagagtaacgaatatgctaaacagaatggtacttggtccccctccagttaatttatcgtaaccataaaaacatcagtggatcaatcagacaggtgacttacgttctattcattggacccgttaaagtcctaacattagagatgccagaaaaacatatatcagatattcatcatacgatccacgttcgaagttgatgtggtttaacaataaatgaataaggtgaaaatttaagcctacagcatttcagttccaagtacaacaactgttggacaaagagtcgaacatgactatgcaagaggaagggagaaaaaaaatttaagagaaggacgaaaaatggacgaaaaataatccaaatccttgaactctttgttgtaagtacacgctgattgttttagacctccagcctaaacttagcttgctcagaagatctaaactactttatacagtatttgttacatctctgcattagcattcctagttattattttagcacatagtttatttaagcttcagctctcaaagaggaagctcttcttttcttgatctcagccttctccgcattccgttggtggattttttcagctagcagcttggcatattcagcggcagcatccttttgtcttcgtgcattctcgtatttcagctctctcaagtgctgttttctctgaatacgctctggagtgatcaatctttgaatcttaggtgcctttgtgtaggtcttgtcacctttcacaacctcacgcctgatgacaaattgcctcacatcatcttccttcgtcaaaccaaaaaactttcatattgttagctctcttgggcccaagttttttcggaacctgagcatctgtaagaccctcaatctgttgctctccttgtctgactactaccaaagataaaacagataaatcagcagcaacaatgcagcctcgtaccgattttcttttgcgttctccaactcttcttggtctgtagcaggagtgacccttggacaatagcaatctgactctggttggatgcatgactccttgcttcatagggaaaccttgtttatcgttaccaccagtgatcttgaagacgtagcctttgaactcgtcagaaactgaatccccttccacttcttgccccatacgtttctcgtaaaaagcttgaagcttgtgctcatcatctatctcaatacatttctgtgtcccattggctgggaaggcaatgttcaatttcatcttggatacctatgagattgagattttcaaattcagaatcagaatgttgtacgaaaaaatttgacaagcgcgaaggaaagcaaaaattattcagtatgacctatagtatatcacgtgcctacaccctaggcataatgttaggacgttcagtaatttacatatatcatatcacatatgctatctttacatgcactatgtcaggtagccttggctttgagagctgcaatgactgattggataactagagtgaaataaattctcaattcgtatctgcaaactttctattccttacacaccttagttacgagtaaatcttctttcaccaccgcgtctggggagacgctcgggtacgggctcctgtaacaatgtttttggcacaataccctctgggatgttgagatattcacgaagatactcaagtccatcatcagtcaaggagtagtagtagtattgccatgaaaattgtgtcttcacatatccttttgaagtcaaagattgcaaggctttgataacgtaaaggttcttagtaccaatctcctcatgttgaatttcaaaatctttctttgcaacaacaactccctctacaaatgttaataacagtccaggcaaatgacaacaagacaaactaaataactctgaggtataaattggcgtcactggacttaggagaagaaatcccatactgaatatgcttgagcgattacgactttcctaatccttctaatcacacaatttaccccctattactaaagtgaagttgagtggtacataccttggaataagtgctggtggatctttttacggtcttcctttggaataagcatcttgtgtaacctttttgtttgaaaaacttttcagaacgaaagtctaatacgattgtagtttggaatgaatcgaggatcgcgaatactattgcccgtggtaagcatgcaagatgtgcaacatctagtaatcaatccctacaccattttctgttagcccttctattagtcacatgatgcctgtgtcttttttctgtattcgaaagcagatctcattttctcgctcagtatgtcaagctattatgttgataaggatcctcaaatgttaccaagtgtatgatcaatcttgagtctaatagaatcctaaatgaattggaaagatctagttcaggagacaatctctgcttgcatgggacccgtcgattggtcattaaatttttggagcaggtgttcaaacctctcaggattgtgaggattgcaaaaattcccctcctcaatattctattgttagtatccttatcatttttgctgttgcggttatcttttcattaccataaactttacaccaagagttcactggctgctacagttgctacgaatatagtactgtatggtatctctgacacacttgctcagtcaattgattgttttcatgcgccgcaattaggggctatacgattgaacgatatttttcagcgtcacacaaccgatagtactactcctaatgacctcagcagcgaactttcagtgtttgttgattatggagaagaggagcaaatgatacaagggtggtcattcgagactcggacctcaaactccgacactagtccacttcctgcggtgcgctatgtagaaagtgatgatcggcctggttttcaattcccaagattctttgggtttgttttttggggattcatcatggctttcgttcaagtggtatggtattcctttttgaaccaagtgtacgtagatgaacctgtggtagtaacagttttggaaagagctttgacggaccagttgtttttttcccctatttctctttattcattttatgcatattccacattgattttggagagaggctcacgacaagatctgcacgacaaactaatgaggttatacatcagtacactagctgtcaacttttgtgtgtggtttccagttcaatttataaatttcctagtgatgccaaagaaattccaggtgctgtttagctcttctgttggtgtcttgtggaactgctttctctcaatgaaaaatgctagttcgccctcatagtggtggcgggcgatgttaagttttgtgccattgcacgtatgcagatgtatgcaagtgaacaaaattgttaaagaagctctctttcgaatatctttgcgcacttctttgtggcatcttagcgttatcttttgtaacacgaaagacatcgacatgagccataattcaagttctgagtcgctagacgtattgaattttgaagtctttgagccttctcctacctctgatagtcattgtaattcagaagtcacttcaaagcgcgttgtgaataaagtttccagccctgcaactatcaatctgccatctcctacacagattccgtacctctattccaaaccaacaacaacttcaacctgcaagtttgtttctgcagttgttgaaaactcccattctgccaattcaataaattacggagatacgaccgcagtagttccaacagaaatgcttggggacataaagacgccacccttagaagataatcatagtagtgtcgttggactggcaaagctgccttatcagaaaaggaaacgagccgaaaggaacggagtgaactttacagttatgcttgtgggagagagtgggcttggaaaaacaaccttcctcaacaccttatttgattctgatatcttacctattaggaagttgaatgtacctcaattggggaatacaatgaagactacacaaattgagtatcataagatgcgattagatgaagatggattcgttctagacttcactgtcattgatactccaggtttcagtgactatatcaataacaactactgctgggtgccaatttcgaactttattgatgaacagttcaggaaatatatatttcaggagagccagccacaaagggaaaggatgaaaagcacccaagtacacgcctgtttatacttcatcaagccgaacttaagagggttgtcggacttggatatcaaagtgatgaaagaactatcgtcacgagttaacctaattccgattatttcaaaagcagacgcattcaatggtactgaaatggagtgtttcaaggagtcgataagaaatacattgtgcaacgaaggaataaatttgtgcaaattgttggcggatgaaggaatggagaataccattttggatacccttcctttgtcggtaatcggctcaagctctcgggtagttaactctctaggaaatgtagtaagaggtagaagttataaatggggaactgtggaagtggagaatgaggatcattgtgactttattaaacttcgttcaatgctattgagtaataacatgcttgacctgataaaatctaccgagaattactatgaaaagtacagatccaaattaatgaaaacccaatttttgaatataatcaagcaagactcggaagcttttaatgaacaacgaggtgatgaaattagtattaaatctgatatggaagaattagttgaacagaggcttagggaccaaaatcctctcgagattctaaaatgcatatgcgacaatcgccctgaatttgataggcagtatgataatactctcaaaaataacctgatttataaggaatctgttcgaattttcaaaaaacaatttgcacgtctcattcagcaacaagatgctaagttcaaagggtggaagcgccacttgtttgacaaacagtctgagtttaaccatagtattgagggtattcataaccagatcttggagatgcgacaatctcttgaactcctcgaaggttcccgaactcttttagactcaagcattttgcctagacgcgatgatgaagcataatagaggaacacccaagtggaaaaagaatcgctagacaaccaagctaaataactctaccagtaaaacaaaataaaaattcaattttagcttcgtactgctacttgttcaatcttttacaattgcattgccgaatcctttttgctgggggcggtcccacgactccccgataggataagaaaaaagactaggcagaatgaatgaatacaattgtcattagctcctattctcggaaaccatcttcaattaactgagatattgcgcgaagtcgccgcagacctccaaaaggtaactgtcaatagcgaccggacctctcattatcgtaaacgtcaagagtgtgatcagctattttccctgtaggttctacaatcacatccgatattttctcaggagatgatgtcctagaggcaaaagaagcataggctctggcaaaaggtccagccaagacatctcgtatatctctcatacgaagaactttaagctggggtgccctttggtccagctgatctagaagattgttcaaagatgtgtccaatcgcacggtgtaaggcaccaatgtttcagaaaacaaagcatcatgaatcactgttctaacaaaacgtggttgcggtactcggtttacattatcaaagtatgatcttgcaattggataatctcgcaggtgttgatagacttttgtggtaatacgatcgtgcccaaattccatgtgattcttctgactatgctcattcagattgtcctggatattctcagttgtaatcaaagttgaatctttttgtgatttgacctccatgtctgctgagctaaacccaaggctccgaattaaagattcaacgataggaggtctcgacatttctacattattagtcattttcatcagaaaaagagttactagtaacctacagcagttaggatagaagggtgtatacaagaagctaataattgcagtagctgaactctacgatttgtgcttttgtatcccagtcaaggtgaaaccatcatttatattcgcgcttctttctcggaactaaacatttatctgtttgtttacaaaaggccaaatgtggaaactttggattatatgacaattcaaaatattgtgctgtgatcaaaagcttactggaaagaatctaatcactattctggaacacaatttgctagctcggaactttcatctatatgttttaccaacaggacgagtatagagctgtgtgttatgaattggagcaatttctggctgaatctaatcttggacaagaccatggttgtaatgatgaatttgatgactcctttgtgcagatggattttaaaagcgtagaaactacttgtgtattgtcttcatttggcaacatgctagactttggacgtaccgtcaaacaaatccaatctccaaatttgaatagcgagattcaacagctgtcgctgggcgacattgaaatggacttggactgccaacttcgaggaatacgaagcgatgaagaaccatccaacgattcggccagcattttagtagatttaaacgatctattaggtggaaacctgagtataatccagaggtcaaacacccagacgcattccaaattcgaagcccaagcatcgcgtaacccttttgatggttcattgtgctctctctatcatgaatccaaggatgagagttttctaattcattccgatgaagaggctctggagtcctccgatcagcggtgtatttctccgagggaagaaagggacacgggtactgcatcattctcattggagaaagaacgccctctatcgatttcaccgaggagagtatgcaaaccgctttctaaggaaaaaatattttccaaattggttaagccagtcctgaaaattcccaagaaatcacttaatttatttgtagattcagcagatggcaggttggacgaagcaacaaagtatgcaacagagatcaactcgctgaatgctgaatgtatcccgttaccagagaacaccaatgaaacggtgacaattccagctgcccattcggccccccatgagaaacgaggagctattgttcgagcggctttgcccatgaggctctccagcaaattggcccaagcgcaagggcagaagcaaggattctatactgttcatcagttcggggactacttgagggaaaaaggctttgatggaactttccttcctcaatttaagacggaattggataacaaagaaaatataaaccacagagaacgttttgttaagatgaaggacctcaaattgataaacttgaagcaaagcaagcatgaactactaaaaaaaaatgtaaggtgggctatcgacctggaatggtgagatcaactaccagcgaagaagaaatcattatcattgaatgatccatggatgcgaaacaaaacgcaagatatttgcagacccggccacttcgaactctcaggtatgcgacttatggagagagttatattacagaaattccgtctgacgtactgacaatggaatcaaataggacaaaagatcaatcagcaactagaaacctgagccacttgtcttggaatatgggtgaagtatgctcgttccttaattttgcttaaaacaaaataccttagaagcaaatacttactagttgacaaatttgcaattattttcaagtagttgatgacatctaccttgatactcaatcagcgttgaagaaacatacttttctaacggcttaccgctgcatgaggcaaagcgagagagaaaggtaaagagatctttgtatacttttgccgatggtcataaaaaaagacaaatcctaagggtaatagagtcctcttgtactatgtcctcattcctttgcaagcgataaggtctatttttttgagaagtccaaatgtttaaagttgtaaacaacttgtttatttgttgagaagatcgagataacgaattacgtccgcattgcgtggaagcatctttgacttccaactgaccagtatacagaacacaacaatgtgcatctattatctctctctgcaatgctcttttatatactttggcttatcaagcttgaatacgaatgaatatccaagcagtatcgagatggttgtgaggactgactatcgatatctgcgaacctatctggttgcatcattaccaatgcaatgttcaatgtttgatgtaggtaaaaaaaaaggaaaaaaagtgaaaactctaacctaaaaatcatcttaaatggcgctctcaatacattcctcactctctatttctattgatattgatactgagcttgtaagatttttggcctgtgaaaggtttttcacaaaggtagtagatgaagttggagtttacagcaacaacaacttgttatttaagaaaggattttgcaagctagatgaatatgtaaatattggtggttacaaattatatttgttgagattagcaaaatcatttccgaaacaaaaacaatgttggggctaggatatacagaatatattgttgtttaagtgagtaagaggaacggaaaccatggttttacctgtagctggtgtagaggacctgcctccaagagggaagtgtgtttactgcacaggtgatcaggggttcgagcccaccaagttccacaacttcgtgaatttgaatgccattaatatgatgatttaaacggatgtgaacaatctcttagtgtctcaaacgagtaccttgaggaaaaaccgttgccttcctactgatatttatttgtttggttctttgacagatctgtctagatgcatttgaagcaagctaagtcttgagatgtctttatccgcaccttcagatcaacgtgaaattagtagagtttctagtctccagttcacttcgcgcgccaatcttgacctgtttttatcttgtaaatctccatttaaagttcgtctccgatatcaagggacaataagaattattatattctgatgtcattgcaggagacacaatcgtatgaaaaaagccaaagcaacgatgatttacttattgaagcagatacttacaaacgtaataatcaaactgtagacatattgccacccagtgatacctctctaaaggggtcaagcattgagaggcagaccacatttgagattggcgatctgtctgctttgaatgggttcaaaaaactcaccaacttaatacagtttcagccagaaagtacatttagagaaagagtagatactcaaattctgaattaccagtttactggagtgagtacaataaacgaaagtattgttgcaaccgtgagaagggacgtcaccaccataggatataaattattacagatattatggcccattgatttgagagagaattcgaatacttttgttaggggagttcagtcactcgaaaacgacgacgacttgagttcttctgagaatacgactagaatcatcctggaatgggatttatgggggcctctaatttttgcgctaggctatagcctgattctgacactttctcagaaaaatagaagtaaccagatgccgaatgaaacccctgagatttttagtggtgtgttcacgttactaacgctcgcgttgtgtgtcctatccctgaatatccaactattggctcctttagatattggaccagcacttaagagattgcctttatcattttttcaaggattgagcattttagggtactgttttttccccgtagttttgggcagtctactctctttgtttgtttttttcaaaccagttcagatcttaatacagtcagcaatgctagtttggtccatttactgcgcttactttttactaaatttcatgcaaaaggaaggcgaaaatagattatttctgtcagtgtaccccgtgttcttagtatttggcactttttcatggctctctattgttggatagagaacgacagggaagatgaaaaattgaagatcggtatgagcaatatgatgcagtgatcgctgagtcgttggatcactgctgagaaacacttgatttttgaggttatatctcttgcaattcaattgcatatggatcaactaagtagagattgggtgttttccttaggtcaataggtacacttagggagcatactctgcttcttggcggattcgctgtggatacagcatggtagtggaagttcttttaaattcgaatcttgtgcaaacgggtgtcaatatccacatatttaaatccgcctatacccttagtctaaagttctctctctccaagaatgtcagaaagatgcctagtttcaagtgttcatatgaaaaaactagacagtgtgaagcagcaaggcaattctcaagcattatttatctggtatgcctctaaacacttgcccagtgagattatgctctaatattagcgcgtgactatcaagagcatgaaatcatgccaggattttttttgacatgactgtcttcaactcccttccgttcactgaggacttctgatgtgcaatcgtgatggaagcggttgtctttgcacgtaaataaaaaaatacaaaacagacacgaattctattctgaccacaggtgatatagtcgcagccgtgcatagcagagtaatgcttcatcgctgaagcgccaggactgatcagaagccagttgtatcagcaattattttcccttgctcatgctactgtataggtcattatttctgagtattgaataagggcagagagtggtcatgaattccatttcaattactgtcaatcgtgatcgagaaaaaatagagagcggacttacacaatagagggcgaagttgacaattaggctgcgttttgaccaagttctcaaatatattttgtcatgttttgttcttcctgttgtcaacattatataattgctctcataatatctatatggaggatatcattcgtaataccagtcaaattgtctgacatcctcagatagctatggttttgttcggtggcagaaatcaccgatttggggtgagaaattcgcgtcggcaggtattttccttaaatatattctgatttgcagcttgaagaaagacataccagcgttgttatcttgacttggaaaaaagttattacgcctttaataaacatagattcgtgacttcgaaatcggccaactagtacactttgttgtgtacaacaattattaggccctgttggttcttcttcaactcacgtgatgtagttatgggtgtagagattgtattcgcttattatcctgattacaacgtaacgatcacaactaaagaatgttaccattattggtgctatcattgcttctcgtgttgggatctttcagtcatcctacaaaaacaagccaaggtggcaatttgcatgtgaataatattctaaaaagcagtaagagattatcaggatatcctccactatttcccgagcacaagaggataatacaggacggtcaagtaccttactacgttgtcgaatacgcacccctggttcatctgtactcggaggagaagtattttccctgtgatattgcaagatatgttgatcactttcatgcagtctttggtaatggcagtgacgttcctgggggtcagcatttaaatattggtgccttatctaagttaaaccattattcagcggcaaaagagggttctgaggtttatctcatggccaatacagattttgacaaaaatcctgattatataactggaaggcacaataaacctaagtatatcaatggagagattgaagaggcacctgctgtgttgattgttgttgataaaggcaatggatgggtagatgcattctggttttatttttacggattcaatctaggtccatttgttatgggaacaggcccttttggtaaccatgttggagattgggaacactcgttagttcgtttctacaatggcagtccgataattgtgtggatgtcggcacatggaggaggcggttcttacttctacaagaatcttgaaaaacactacaacgatgacaaacggcctgttatattctctgctcgagggacccatgctaattacgcatcagtagggcagcaaaatcatgatcttccatgggcaatgctttcggatttcactgaccgaggtcctttgtgggatccgacaaagaattttctggcatacacttacagtgatggtcgaattacttatgcaaatggatctcatcctaagagggaagaaaggtatggggattggctatattttgagggaagatggggtgataataaacttccaagctccgatgaaaggcaaaaatggtctccattcgagtggaaatacattgctggaccaactggaccactatcaaaaaacttggaccgccttagcccctgccaaagaacgaagtggtggaatttttgggacggctgtaacacacgagtttatcccaaaatgggacaagggatagaaagtgaggggaataatggttgtggtaatattttcaggggtattaggtcgggaattgttagaagctttgtgcaaactatcacctggggaggttggggttgttgggttttagatttaatctacggataatcgcacatagtagagctgatgtgttttgaagctggaaaagtaaaaacacttttccatttgacctactgtttagcgagtggagatacacccgtagatgtgagggtggaaaactttacttacgccgtcttatgagctgcaatatatcaaaaaggcctaagcatcaacgcacctgatagagctttaccaaatattcatcgtaataattttttggcgattatcatttatttcccagggcccagcaaaactttatgaagtatatggaagtcatataaaaagctacaataatgagccaagctccgaaaacaaaaaggctcgatagcaacttggtttttttcatagaagtaataacaatctttccagtttcgaggggggcagagcattagagcatagcatacataccttgaatcaatctaatcaatgtttaattaacaactgcatgtttatgctgacaatggtgccatttttgaagtcgcataacctgtctatcaaaacaagctatttgatgttgttaaaacaacctcgacttcggttactgaattgagtgaatcgggattgatttgtgagttgtatctcagatagatctgaactggttgaaactgtttttctacttttcttggatggaaatcttttcataaaaaatttatggcccttactagatacttaatggggaaattaagcagagggaaaaaatcgattattgaatcatcttgacttgctataatttgcacattaacccccagagccattttgaactcaaaacggctaatcattaagacatccaaaagtagctgaacagtaagattcagactattagaaggcactaatgttcatactatgtggtaactatttagccaatgtaacaacgcgcagtgatacttaatggtgttgttagctattgtcttgttcaaatggttgtcaatttccgtcacttcaattgttggtttcatctaggaccaactatttttttttctctgccattgactcatgaatgttgctggcagctagcatctgtaaatcattccatttctagtagtcttttaatacaaatgcaaacttacacatccggatcttaacttgcgtacatggaaagaaagttctcccgagtggcaacgccacagaaaattcaattatggagcccgattgaatgaaaatgtataatatataatcgttgtttaccaaactgagccattatttccaattaccttggacaagaagccttgcatctgaaatgctaggaaagaaaaagaaagtgttcctgttccattagtgacgggtgtaaaacggatagcattggtctcaaccgcaaacaatatgtttccagttgctcaaatattccataacgatttagaggataatgcgtgatagatttgttatgacaatggccgctttcctgttcacatcttcgatgtttttaagctttgtcaaatggtcaccatgaaaagttatataatgcactaccaacttgtgttagtgaacgatatcctgttgtttaatgaaaaaaaacgatgacattaggaacactgaaaagtactcgatagtatggctcacaggaaactgcaacagtatgttaatatcttcttcgaatcttactgaaagagacggttactgactacttttcagggagatggaccgggtgtttaaacgtattggggaaggtctatatatctttgattccctgtacgataggcatcaaagctgttcaaactcatcacagaaagataagctggaggctgatctaaaaaaggaaatcaagaagctgcagcgattcagagaacaagtcaagagttggcaggcgaccaatgaaatcaaagagaagaggagattgatagagaacagaaagctcgttgaaatagccatggagaaattcaaatcagtggaaaggggctccaagcaaaaagcctattcggacgaggtactaatggggatctcagaaagcatggaaccagaagaagctgcaaagtttgctgcaatagagtttctgcagaaatctctagatgagattgaacgacaggtggaagggcttgaagctgagattgataaggctagtttctccaaaaaaagtcgcaaggctcattctgacattgacgagcatcaagaagttttggaagttacgcttgagcgactccattggcaccaagaaaagttagagattgcacttcgtttattagagaatgatattttgaagcctgaaaagttgatgcagatcaaggatgatttggaatattatttggaaagcaaccaagagtacgattttatggaagatgatactctttatgacgacctcaatctaaatgtagaccaatctttggcgcatgaggtcactacttccttttgtaaagcagaagaccatgatgtttccttgagccccctcccttcaacagatagcacttcctcagtacataagaaactcaaagaagacccccaaaaaagctcttttggttcacaagttctttcaagtaactctgcgagtccggtaagcactcaatccctcatggacagcggaccccagaattccaaactactaacaacttctttacgacctgcctcagtgccagttaaaccttcgtcagacgtgagatgggctgttgccataaataaaacagacaagctgttccaggcaaaacccatttccagctcttcagagcagtttacctctctgaatggctccttgacctcctctcataaccagcagcttatcccccaagatcaaaatcgaatatcaataacagatagtacgatagcctcaatgcccccaggtattcaaaacctgatccttggttttttggattcaaggaagagttcgaagaaactcatgaaaagtaatgcgatttacacacaagcatggaatttctcttcatatttttctccaccagaaactgctataccttcttcattagaatcacagagagttgcaatgatttggaattcaattcgtggaagtgccgatttgcattctttggtgcaacgagtggatacagcaaccttattttacgccttttactttgcgtcaacgccttatgaaagggttgtttctaagaatgtacttgtaaatttaagacattggaaactgcaccacaaccaaaagttatggttccaacgttttggccaacctaaatctgtcggggagggctttgagattgccgatttcaaagtgtttgacgctgcttcatggagtctgaaagagatgcttaactacaagtttgagtacagtttcttattttctgacaatgcaagataaagttcaaatattacccaaagtccctaaattttttatcgctttcctccatattttgagccacgcttcttgtaatgatcgaattgttggctcccttcaatggcgaatagagaactcaaaattcttcatgacattactgtattcagattattcaattgccccctcaacatagtgctcacttgttccttacccagcataactgagaccaaaacagatcgtagaagttgaacaaaatggtcatacgactgcttgtagtctgtttgttttgccatttcaaatttacttataaataggataggcagcatcattaatagcataggtaaccaaatgaaaaacagccttttatcattcagcacagatttacggctattttgactagcaaaactgtattgaaacgtcttagtagcctcttcagaaccgaaatctcgaacaatatcgacgctgccatctattaacgtttcaggcatatcagaaatttgacgttcttgggcatcttttgtgaaggaagacgtagtaaacttcattagggatctgatagatgagtcattagggaaaagatcatcataactaggtaagttctcttcaggtaagctatccacggagtgggcaaaggatttgttgacgggttggaaaacattttgaacctttctccacaatttcaatttagttcgtttatttccgtcataatccgaagtaatggtatccgtttctgaatcgatagctggcgcactatccgttttttcagattcagaatctgtagggacagaatcagcagaaacggggagttcatcattatcactactcatattctcatcatctgcatcttcctcttcttgatcgtaaagaataaaatcggcaaaactacttgacctttgctgctctgtgctgtcatgaacttcgtagaccatacgtgaaactttgtattcaagcgcactttcatcaatattactgaatatcgaagtgagcgaatcagaagagagccttctgtctaacaattgatctgacctgacaccaattcctattaggtctaaaacgttagaatcggtgatatcttcaacattaacctgattgtttatcttcatagataaagaggctctacaccgaattaataattcagatacctctctttgcccgtttaccagggctaggtgtaagggagttaagtcattgatatccttatggtcaattttgcatcccctctctatcaaaaataacactaaattcacgtaacctttcattgcagccaaatgtaatagtgtgtgtccctcaggagtacataaagaaaaatttggctttgaaattgggcaattgggaagctccattagctccataaccttcaaaagtaagatctcttgttcccagttctctttcgttaattccttaacggtagttgttgctgtcgacaaccattcctgatgtacggcattttcaatgttgttcaacatttctggtgagttctgaacactctgtgctaccgaattttcacccgtatgaccaacaatacgtttagcgatattttttgcatcttccaattttccattcatcttcaaacccacaatctgtaaggcgagttcaattagctgtctgtcagaatcgtccagatatgtgaacacctgcgtagcaggtaggctcacatcttgttctcctgagtttgcatcctcgaaagttactaaaacctgaccaggttgtgaagatgggggtaagtatgtaacgatagtggattctgaccaacaatgagtcgccaatgccaagttagaaccgaactttaccgcaagccccggacgaaagttggaaccaaggagagtgacttcgataccgcctctaactggcccctgggcgggtattattctctggattgtgggcttatttgaaacgtcggacttaataataggcggaggtacctgaaagcaatgtactcccttcattccctgagaagaggtgcttgttattgatgttgatgagcagtagtttgtgttgcgatctggcgttgtactacttccagaagcacttgcaatagagccgatcctactcgtaggagacctggccacatcagcagtattaggacttgtaggttcctttttgagagaggctgcaacggcgttaacatcactccagggtctcttttgacgtttcgaccccctttgggatccgagctgtccttgtagcagggtctcgttttgagattgagtacaatctgtcgatgattcatcaatggaagttggagaaagtggatgattgcctttaagcgagacaccgctcgattgcacattctttttcctgtccataatcataatgttacccgaaaagcacttgcctagaacttcacctttggaatttctcaaaacaaacatcagcttgaatcctttagactcttgatgatgcctgcaatagcaaactattcgggaaagtagatcaatctttttttcagccatagtccccgttggtgctgggaaagaaacaatctctttgcaattaaaaattatagcccttcttggtgtactcagactccagcttgcaccatcctctgtagatccattctttcgcctcgatgctctcttaagttctctacgaacacacttgctacaaacattgcatgattgtgcgtcaccaactgagttcgaatcgctagtaacaacaaaagtatcgagataaagtaagtgtggctgcatacttacaggaatatcaccattcagacaaagtttcgattttgcaatagtgtcgttgggtaggtgaagtaagaattggggcggcgcaggagaaatggaaagctcaatcttgatctgggtttcaactctggatgaaactggcaatccacctattcttaatgagtagggtaaacgttctggttctaaagaaagataattggagggtattgaaaaattgttcttcggagacggcagcacgtaaccgacatcgttttcattgcttatttgtagtgggcattctgagctagcgcaagtatctctacttggaccaaacttcaatctaatcagctcctctcgggatctttcgtactcgtaaaattgtgaatcatctgttttaagagatcgttcactgcccaagaaggaatcgatagagacatgtttccgatctatcgtagagtcaccaaggtgggaacccggaggcgtgactggattgatgcagagatcgttgtccatatagtaggatacgttggagtcattattgttgtcacttggtggttgcaacaaacccacaggaggcatttgggaggtgccaccaagtgtctcgtcatgcttcgaacttgagatattgtcgtatatgttagcatccaaaaattcatcaagcacatcatcattgccatttctatccagcttttcctgatcttcctcatggctaacggtattatcgtaaggtagattcgcaagaaatatatccaaagatgcttcgttcatggggaatataatataactatcttgttttggtcaggcaacaaccactcgtctttatgaagcacagaaaaagttgacttcaaacctatgtgtaaaactagtcaaaaattggcagaggtcaggtaggatcaaataacaaatgctgcccaaatttcttacaagtgttgagtataagtagtcttgagagttgggtctccaatctacaattttgaaactttaaacttcaacctgtcattggtgaagacactactaatattacaaggcaaataacatacactgcattttcttgaattttaagattagctcacaaaagtgatggcttctatccgctagttcagaatttctgaatggtagccagtactataatctcattatatcatcccatagcactgaattatcttcttgatgtgccataagggcaaaagcagcgagtgagcaacataatttcgtggtgctatcagctaatgtgccactgtctgtaggatttgctttagctgccaccaaaattatattgctgcaataagtacgatgtgcttaaacacctgttctagatttttcagatctttaaggtagtaaagccggtcaaaaatgttagttggtgtaggcactaatcctattctctcttatcccgacgccgatggtaacttcgctcatttatctcgccaatattgattgcacaataggagctctcaccatattctagattttttggttcatacgcctatagcgggagacaggcagtacgttccttaatagctttagttgttggacttgcagtgtggaataaacgggaccaagaaaatcctaacaattcaaattgagtacgtacacgtttggccatcgctgaatgatacgcaaactggcatcagcaacactttaatcacagttttggtacatgttgcttgagacactacagatggtggaccatatggggtgatcgatgtttctatttccgaagaagacgtattgagatctttccgatatgtcgaatttactgatacagcagattatttgaagatgccagctagaactgcttgcaaatttccaatttttgaaaatttgtgaaaatgatttaagctaatgcttcttatagtagtcatagaatagatgccagagaggccatagaattctagaactatggatcttgctcgctaacctttaagggtcaatgggttataaaattctccagaaatgtacaataaaaagaggggcaacattgagtaggtatttagtttatgcagtcaaacaggagctaatttctcatccagccgatcactatatttcaatagcggctattagcttggggttagccagtggtaatttttttttagtgtttaagagaaggatctcagtagtgactttcaatcagaacttcattcagggaccgtagcaattggtagcttgtgaccaagtatgagcctcactggcttgatagtgttttctttctttctacaggctaaacagttgctcactacaaatgcaagcttcatggtattctatctatgtcctccttatttcacgttgagaatgaatgcagtatagtactcagtgaagagattttcgtgtatctctctatctgtctatgcgaatgagaaaatctctctttgtatccatttgtattcaaatttaaaccaactatggttggtgacttaaatctgaagaagtcttggaatccaaagcttctgaagaaccaagaaaaggtttggaaaagagagcagcacgcacttgaagaacaccaaaaaatccaacagcgcttggaggagataggcaaagagaaagaaaaaagtgcaagtttaagctggcggcatccaggtcaaccagagaagttttctcaagtagagatgcgcattgattggatgtacaacgaacaaaactataagacggatgattacagtcgcaatggagttaacaaaaatgtcgtgaagcagaatgcaaaagaacatgaagaatttctgttgggaaaacgaagaaagggtaaaggagtgcaaaaatcacaaaataccaagagacagtttatacccaagcaagatggtgaaactaaaatttaccctgaggttaatgcctctgaaagcattgtgaataaaacaatcggcggcaacgatccattgcttgaatttcaaaaagctacaaaggagagagagagacaaacaaagaaacagatcacacaactgtgaatcgtaaatttcccaatcttaaattcaaaaccgaagaaatctcaaagatggtatggtatgtattattcgagtggattcttatttagtgagtagtccgcagagcaaacttgaagccttgaatatgtcagaaaaagaaaaaccggaaagtacctatacaagccatcattgccagcaaagtagtagactctgtgaacacaagttacctcccacaggcatagagcaaaactaagatagagtgatccttgtaagagcatacaaattggtcctaacagaatcagaatccatgaattttgatgttcttcttttgaagagctagctgagaggtcaaaaactccatgactttcactctctgatctccttgcagctggatgacctgaccaagttcatcatcttttacaatattcccattacaagcaaaatctttcttcaaaaccttgaggatcttctttaggtcatattcttctggtaagccctgaacggtggttaatgtctttctaccatttctctgttggatacggatatgaatgtagttagtgggctgtgtatcatcatcgcctgtatcggcgaacggatcaaaagactttaggttccctattgatgccataaaaagtggacaagtatgtcgattatcagagaacaaatatagtccgaaaaagaaaaaagagaatgaagtagttgcgttgcaggaaggcaaaaaaattgttgcaaaaaacaaataaaaaactactcgaattcgcgaaagaataactatgggatttcagggaaatagtaggcagaaggggaggacgggaagggaagggtaatgggagatgacaggtacacttgtagaagcagaccaggtgaaggtaattctgtgtgactttgacaatagattgaatgttattcgagagaaggagatgaggacatcaaaaatgtgagggagtgaggggagggagtcggaatctaaataaatgggaagaggaatcacgacttcttgtgttccgcctgacgctcaagaggattgtcaccttccaggggggttctatcggtaaaaaaaaaaaccgcccgccaccgaaaatttcgactagataatgagccgacaagaggcagatctcaaagttagcatcaagaaggcctgttccaccgaagaagctgctccaaaaagaaaacatgttagggcgtgtattgtgtttacctgggaccatcgctctagtaaagcgttttacaacggattgcggttacttcctattcagaatgacgagataccgcttttcaaatcattgatcacgattcataaagtacttcaggagggacacccttctgcgatcaaagagggaattaagaatagagactggattcaaagtcttgggcatgtgtttcccggtgacggaatgaagaggtatggccgattgattcgtgagtacgatagatatctcattcgaaagattgatttccacaatagtcacaaaggattcaacggtacgtttgagtacgaggagtatgtatcactgaagactgtaagtgatcctaatgaaggttatgaagctattatggatttaatggtactgcaagattcgataaacgaccttcagcgacttctgtttgcttccatcgacagctctagtcattctgaattaaaaatcagtgctttagtgccccttattgctgaaagctacggaatatttaagtttattacctcaatgttaaggggaatgtgtcactctttaggtcacgacgatgaagcattgcaacctctgattgaacgtttcataagccagtattctgacttgtacgacttttatgccgaatgttcgtacgttaagtatctcaccagtttggtgaacatccccaaactgccgtttgaagctcccgatctattcaattgggacgaaactgacgagctgaaacctcgaatcctagcggaagaaccatctcttcaggtttctagtaaggcaccatctgaagaatttggtacgccaaccgaggtgattcattcacagccgactgcaggcacggatctttgggctcagtcaaatgccctaaaacagcaatacgaacaagaacagcaactcttggagcaggaacgtcagcaacagctcctcgagcaacagcatcaacagcaacagcagctagaatattgggagaaacaaaaggagcttcaagagcaacaacagttgtatgcacaacagcagctggaaagtgaccaacttcagagacaagttcaaggacgtgttggtgagctagaacgtgatttactgattttaagaggacagtttgacagagatcaattaatgctgcggcagtatgatgagagggtaaaggcccttgagacagagctttctagcactacgcagaatgcacaacaacaactgggggcgaaggaggagctattaggcaacatacaggagcaggctgcccaatggaaatccaaatatgattctttagcaaagctttactcccaattgagagaagaacacctgaatcttctttcaaaattcaaaacggcacagttaaaagcttcgtctgcccgagaagcaatcgataagagagaaaaaattgagagagatctcaaggctaagaacatagagttggcagatttaatccgtgaaagagatcgtgccaggctagatcttgaacgatcaaagagtgacaagaatagtgaaactgaaaggctagaggctcggcttcgggaacaggaaactaagctggccgacatcgagaaattacactcttcggagctcaaatctttcttgagtcagcataacaaggaaatagaggaactgcaaaatcaactgcaagcttcttctttgtcagaatctgcaaatgaacgtctcaaagcactggaagcgcagttacaagaaaaggatgacgagttagcaattgcacaccaaacaatggaggcaacaattaaagagttgacagggcaacaaagcattcaaaattctgctatagacgaacaaattgacgctattctactggagcatattgataaactaacggaagttatcgatgcgatcctaacaagtggagtgcaaagaattcaagatggtcttttcgagctggattctccaatgcaagcaggaaatcagaattcatccccggagtacttgtcttctattatcgagaaatcatcaaatttggccactgaattcacttcaagttttaatggtttcatcgcagatggccctaacggggatcatgtatcggttattcagacaataaccgagtttacaacatccattgtcgatctattacttaactgtaagggagtcgtaagattggcttcgagtgaccaggaagcggaagcacttcttaattcggcccgtgatgtagccgaagagtctgagtcttttatcgtttcattgtattcttcatcattaaaggggctcagcgaccaagaaaagacagataaggctattgagggaaatgtggacatccagcaggaattgcagaccctttcttccttagtagagaaattaatatcgtctcaagttaacatcaatgtcaacgacaatgtcggagaactagttgacagagagatggcacatgctgcagaaacaattgctaaagcctctgatcatttaacggatttattaacgaatgcgaaacaagatatttcaaccatcgatatgaagattaacaattctattctatcagctgctattgcagtgactaaagctatcattcttttaattaagactgctactgattgccagaatgaaattgtcaatcatggccgcggttcaagcagccgcacgtctttttacaagaaacacaacaagtggactgaagggcttatctctgcctccaaatcggtagcatactcaaccaactctttgatccaaattgctgatggtgttttatcttcaacaagttcaccagagcagctgatcgttgcctgtaatgacgtggctgcatctacagctcaattggttgcggcatctagagtcaaagctagtttcatgagtaagacacaagacaaattagaacttgctagcaaatcggtgacctctgcttgcaggtctttggttcgtcaagtccaggaaatactctcacaaaaagataaagaggaactagaaattgactacagtaagttatcagcgcacgaaaacaagacggtgcagatggagcaacaggttgaaattttaaagttggaaactgctctacagaatgcgcgaagacgtcttggggaaattcgacgctttggatacc

SEQ ID NO: 116 - DNA, 16 bp, Artificial Sequence
  ABF1, predicted binding site for transcription factor
ccgtaaaaagcgatac

SEQ ID NO: 117 - DNA, 10 bp, Artificial Sequence
  PHD1; predicted bindingn site for transcription factor
acctgcatca

SEQ ID NO: 118 - DNA, 14 bp, Artificial Sequence
  YGR06 7C; predicted binding site for transcription factor
accccacaccctac

SEQ ID NO: 119 - DNA, 19 bp, Artificial Sequence
  Primer oligo2395
tcctcgtccaatcaggtag

SEQ ID NO: 120 - DNA, 19 bp, Artificial Sequence
  Primer oligo2398
agtggtacctgcagctaag

SEQ ID NO: 121 - DNA, 1833 bp, Artificial Sequence
  codon-optimized human serum albumin (HSA) sequence with its natural signal sequence exchanged by the LLP-signal sequence
atgtttgagaagagtaaatttgtggtttcgtttctgcttttactccagctattttgtgtccttggtgtacatggagacgcacacaagagcgaagtggctcatcgtttcaaagatctgggtgaagagaatttcaaagcattggtgttgattgcatttgcacaataccttcaacaatgtccatttgaggaccacgtcaaacttgtgaatgaagtgacagagtttgctaaaacttgcgttgctgacgagtccgcagagaattgcgacaagtctttacatactctgttcggagataagctgtgtacagttgccaccttgagagagacttacggcgaaatggctgactgttgcgctaaacaggaacccgagagaaacgaatgttttctgcaacataaggatgataaccctaatttgccaaggttagtacgtcctgaggttgatgtcatgtgtacagcttttcatgacaatgaggaaactttcttgaaaaagtacctgtacgagatcgcaagacgtcacccatacttctacgctccagaactcctgtttttcgctaagagatataaggcagcattcacggagtgttgtcaggccgctgacaaagctgcttgcttgttacctaagcttgacgagttgagagatgaaggaaaagcctcatcagctaagcaaagactaaaatgtgcatctcttcaaaagtttggtgaaagagctttcaaagcttgggccgttgctaggctctctcaaagattccccaaggctgaatttgctgaagtctctaagcttgtaacagatctaactaaagtccacactgaatgctgtcatggagatctgctagaatgcgcggacgacagagctgacttggctaaatacatttgtgaaaatcaggattcgatcagttcgaaactcaaagagtgttgtgagaagccactattggagaaatcccattgcatcgctgaagtcgaaaatgacgaaatgccggctgacttgcctagtcttgcagcagatttcgtagaatcaaaggatgtatgtaaaaactacgccgaagcaaaagacgtgtttttgggcatgtttctgtatgaatatgccaggagacacccagattattccgtagttttgttgctgcgtttggctaagacttatgagacaacgttagaaaagtgctgtgctgccgccgacccacatgaatgttatgccaaagtttttgatgagttcaagccattggttgaggaacctcaaaacttgataaaacaaaattgtgaattgtttgaacaattgggtgagtacaaatttcaaaatgcattgctggtaagatacaccaaaaaggttcctcaggtttccacccctactctagtcgaggtttccagaaacttgggaaaggtgggttctaagtgttgtaaacaccccgaggccaaacgtatgccctgtgctgaagattacttgagcgtcgttctcaaccaattatgtgtgctgcatgaaaagacgccagtttccgatcgagtcaccaagtgctgtactgagtctttggtaaatcgtagaccttgtttctcagcattagaagtggacgagacttatgtgccgaaggaattcaatgctgaaacatttacttttcatgctgatatttgtacattgtcagaaaaagagagacaaatcaaaaagcagactgccttggtggagcttgttaaacacaagccaaaggctactaaagagcaattgaaagcagttatggatgattttgcagcattcgttgagaaatgttgcaaggcagacgacaaggagacatgttttgccgaggagggtaaaaagcttgttgcagctagccaggctgctttgggactttaa

SEQ ID NO: 122 - DNA, 17 bp, Artificial Sequence
  reverse Primer 2892
tgtcgaaccaccactac

SEQ ID NO: 123 - DNA, 33 bp, Artificial Sequence
  forward Primer_Yo_218
tatacctaggtggtggaactttattattctttc

SEQ ID NO: 124 - DNA, 30 bp, Artificial Sequence
  forward Primer_Yo_219
tatacctaggtattagctggtaattgagcg

SEQ ID NO: 125 - DNA, 29 bp, Artificial Sequence
  forward Primer_Yo-220
tatacctaggttggagggtatggtcagag

SEQ ID NO: 126 - DNA, 30 bp, Artificial Sequence
  forward Primer_Yo-221
tatacctaggtttcattccatcttgccatc

SEQ ID NO: 127 - DNA, 30 bp, Artificial Sequence
  forward Primer_Yo-222
tatacctaggcttacatcaataattaaaac

SEQ ID NO: 128 - DNA, 30 bp, Artificial Sequence
  forward Primer_Yo-223
tatacctagggcaagcatatgcttaaaagg

SEQ ID NO: 129 - DNA, 576 bp, Artificial Sequence
  shortened LLP-promoter sequence delta29 corresponding to a 576 bases length of the shortened LLP-promoter
tggtggaactttattattctttctacgatccaagcattatgttgtggaacaaagcgaatactcttattagctggtaattgagcgagttgaaaaaatcaagtctattggagggtatggtcagagtactgatagagatccctgttaagataatcgatctttttcaaatatccaatttcattccatcttgccatcgggtcttggcttcttacatcaataattaaaactacttactctattagtgccaaaaatggtaaaccgtattcaaattgctgcaagcatatgcttaaaaggatcgcgttgcgagcttcttttgagattcgcaagcttgattttatgctcttgtgggaagaaaagcaacccactgaattccagatttgttgtgttttcatgcatggacgacatactttgagtaataccgttactgagattttaccgaattcgcattgcgttgaggcgtgaagtttcttaatgctgtgccatatggttaagttgcgtttcaagatggtccacaagtatttttgtatttaagcagtgtcaattcaagcctaactgctcataaaaactacacggtttgct

SEQ ID NO: 130 - DNA, 512 bp, Artificial Sequence
  shortened LLP-promoter sequence delta93 corresponding to a 512 bases length of the shortened LLP-promoter
tattagctggtaattgagcgagttgaaaaaatcaagtctattggagggtatggtcagagtactgatagagatccctgttaagataatcgatctttttcaaatatccaatttcattccatcttgccatcgggtcttggcttcttacatcaataattaaaactacttactctattagtgccaaaaatggtaaaccgtattcaaattgctgcaagcatatgcttaaaaggatcgcgttgcgagcttcttttgagattcgcaagcttgattttatgctcttgtgggaagaaaagcaacccactgaattccagatttgttgtgttttcatgcatggacgacatactttgagtaataccgttactgagattttaccgaattcgcattgcgttgaggcgtgaagtttcttaatgctgtgccatatggttaagttgcgtttcaagatggtccacaagtatttttgtatttaagcagtgtcaattcaagcctaactgctcataaaaactacacggtttgct

SEQ ID NO: 131 - DNA, 472 bp, Artificial Sequence
  shortened LLP-promoter sequence delta133 corresponding to a 472 bases length of the shortened LLP-promoter
ttggagggtatggtcagagtactgatagagatccctgttaagataatcgatctttttcaaatatccaatttcattccatcttgccatcgggtcttggcttcttacatcaataattaaaactacttactctattagtgccaaaaatggtaaaccgtattcaaattgctgcaagcatatgcttaaaaggatcgcgttgcgagcttcttttgagattcgcaagcttgattttatgctcttgtgggaagaaaagcaacccactgaattccagatttgttgtgttttcatgcatggacgacatactttgagtaataccgttactgagattttaccgaattcgcattgcgttgaggcgtgaagtttcttaatgctgtgccatatggttaagttgcgtttcaagatggtccacaagtatttttgtatttaagcagtgtcaattcaagcctaactgctcataaaaactacacggtttgct

SEQ ID NO: 132 - DNA, 404 bp, Artificial Sequence
  shortened LLP-promoter sequence delta201 corresponding to a 404 bases length of the shortened LLP-promoter
tttcattccatcttgccatcgggtcttggcttcttacatcaataattaaaactacttactctattagtgccaaaaatggtaaaccgtattcaaattgctgcaagcatatgcttaaaaggatcgcgttgcgagcttcttttgagattcgcaagcttgattttatgctcttgtgggaagaaaagcaacccactgaattccagatttgttgtgttttcatgcatggacgacatactttgagtaataccgttactgagattttaccgaattcgcattgcgttgaggcgtgaagtttcttaatgctgtgccatatggttaagttgcgtttcaagatggtccacaagtatttttgtatttaagcagtgtcaattcaagcctaactgctcataaaaactacacggtttgct

SEQ ID NO: 133 - DNA, 372 bp, Artificial Sequence
  shortened LLP-promoter sequence delta233 corresponding to a 372 bases length of the shortened LLP-promoter
cttacatcaataattaaaactacttactctattagtgccaaaaatggtaaaccgtattcaaattgctgcaagcatatgcttaaaaggatcgcgttgcgagcttcttttgagattcgcaagcttgattttatgctcttgtgggaagaaaagcaacccactgaattccagatttgttgtgttttcatgcatggacgacatactttgagtaataccgttactgagattttaccgaattcgcattgcgttgaggcgtgaagtttcttaatgctgtgccatatggttaagttgcgtttcaagatggtccacaagtatttttgtatttaagcagtgtcaattcaagcctaactgctcataaaaactacacggtttgct

SEQ ID NO: 134 - DNA, 305 bp, Artificial Sequence
  shortened LLP-promoter sequence delta300 corresponding to a 305 bases length of the shortened LLP-promoter
gcaagcatatgcttaaaaggatcgcgttgcgagcttcttttgagattcgcaagcttgattttatgctcttgtgggaagaaaagcaacccactgaattccagatttgttgtgttttcatgcatggacgacatactttgagtaataccgttactgagattttaccgaattcgcattgcgttgaggcgtgaagtttcttaatgctgtgccatatggttaagttgcgtttcaagatggtccacaagtatttttgtatttaagcagtgtcaattcaagcctaactgctcataaaaactacacggtttgct

SEQ ID NO: 135 - DNA, 2901 bp, Saccharomyces cerevisiae
atgaatccgggcggtgaacaaacaataatggaacaacccgctcaacagcaacaacaacagcaacaacaacagcagcaacagcaacagcaggcagcagttcctcagcagccactcgacccattaacacaatcaactgcggaaacttggctctccattgcttctttggcagaaacccttggtgatggcgacagggccgcaatggcatatgacgccactttacagttcaatccctcatctgcaaaggctttaacatctttggctcacttgtaccgttccagagacatgttccaaagagctgcagaattatatgaaagagcacttttggtaaatcccgaactatcagatgtgtgggctactttaggtcattgttatctgatgctggatgatctgcaaagagcttacaatgcctatcaacaggctctctaccacctcagtaatcccaacgtaccgaaattatggcatggaatcggcattctttatgacagatatggttcgctcgactatgccgaagaagcttttgccaaagttttggaattggaccctcattttgaaaaggcaaacgaaatttacttcagactaggtattatttataaacatcagggtaaatggtctcaagctttggaatgcttcagatacattctccctcaacctcctgctcccttgcaggagtgggacatatggtttcagttgggtagtgttttggagagtatgggagagtggcaaggtgcgaaggaagcctacgagcatgtcttggctcaaaatcaacatcatgccaaagtattacaacaattaggttgtctttacggtatgagtaacgtacaattttatgaccctcaaaaggcattggattatcttctaaagtcgttagaagcagatccctccgatgccactacatggtaccatctcggtagagtgcatatgattagaacagattatactgccgcatatgatgctttccaacaagctgttaatagagattcaagaaaccctatcttttggtgctcaatcggtgttttatattaccaaatttctcaatacagagacgccttagacgcgtacacaagagccataagattaaatccttatattagtgaagtttggtacgatctaggtactctttacgaaacttgtaacaaccaattatctgacgcccttgatgcgtataagcaagctgcaagactggacgtaaataatgttcacataagagaaagattagaagctttaacaaagcagttagaaaacccaggcaatataaacaaatcgaacggtgcgccaacgaatgcctctcctgccccacctcctgtgattttacaacctaccttacaacctaatgatcaaggaaatcctttgaacactagaatttcagcccaatctgccaatgctactgcttcaatggtacaacaacagcatcctgctcaacaaacgcctattaactcttctgcaacaatgtacagtaatggagcttcccctcaattacaagctcaagctcaagctcaagctcaagcacaagctcaagcacaagcacaagctcaagcacaagcacaagcacaagcgcaagcacaagcacaagcacaggcgcaagcacaggcacaagcacaagcacaagcacatgcacaagcgcaagcacaagcacaagcacaggcacaagcacaagcacaggcgcaggcacaacaacaacaacaacaacagcaacaacaacaacaacaacaacaacaacaacaacaacaacaacaacaacaacaacaacaacagcagcagcaattacagcccctaccaagacaacagctgcagcaaaagggagtttctgtgcaaatgttaaatcctcaacaagggcaaccatatatcacacagccaacagtcatacaagctcaccaactgcaaccattttctacacaagctatggaacatccgcaaagctctcaactgccacctcaacagcaacaactacaatctgttcaacatccacaacaacttcaaggccagcctcaagcccaagctccccaacctttaatccagcataacgtggaacagaacgttttacctcaaaagagatacatggaaggtgcaatccacactttagtagatgccgccgtatccagtagcacccacacagagaataacacaaagtctcctcgtcaaccaacccatgccattccaacgcaagctcccgcaacaggaataacgaacgctgaaccacaggtaaagaagcaaaagttgaactctccaaattcaaacatcaacaaattagtaaatactgctacttccattgaagaaaatgcaaaatctgaggtgagcaaccaatcgccagcagtagtggagtctaataccaataatacttcacaagaagaaaaacctgtaaaagcaaactcaataccttcagtaattggcgcacaggaacctccacaggaagctagtcctgctgaagaagctaccaaagcagcttctgtttctccttctacaaaaccgcttaatacggaaccagagtcatctagtgtccaaccaactgtatcatcagaaagttcaacaacaaaagcaaatgaccaaagcactgctgagaccatagaactttctactgctactgttcctgcagaagcaagccctgtagaagacgaagtaagacagcattctaaagaggaaaacggcacaactgaagcatctgcaccttctactgaagaggcggagccagcagcttccagagatgctgaaaaacaacaagatgaaaccgctgctacaacgataactgtaatcaaacctactttggaaacaatggaaacagtgaaagaggaggccaaaatgcgtgaggaagagcaaacatctcaagaaaaatccccacaggagaacacacttccaagagaaaatgtagtaaggcaagtggaagaagatgaaaactacgacgactaa

SEQ ID NO: 136 - DNA, 2142 bp, Saccharomyces cerevisiae
atgactgccagcgtttcgaatacgcagaataagctgaatgagcttctcgatgccatcagacaggagtttctccaagtctcacaagaggcaaatacctaccgtcttcaaaaccaaaaggattacgatttcaaaatgaaccagcagctggctgagatgcagcagataagaaacaccgtctacgaactggaactaactcacaggaaaatgaaggacgcgtacgaagaagagatcaagcacttgaaactagggctggagcaaagagaccatcaaattgcatctttgaccgtccagcaacagcggcaacagcaacagcagcaacaggtccagcagcatttacaacagcaacagcagcagctagccgctgcatctgcatctgttccagttgcgcaacaaccaccggctactacttcggccaccgccactccagcagcaaacacaactactggttcgccatcggccttcccagtacaagctagccgtcctaatctggttggctcacagttgcctaccaccactttgcctgtggtgtcctcaaacgcccaacaacaactaccacaacagcaactgcaacagcagcaacttcaacaacagcaaccacctccccaggtttccgtggcaccattgagtaacacagccatcaacggatctcctacttctaaagagaccactactttaccctctgtcaaggcacctgaatctacgttgaaagaaactgaaccggaaaataataatacctcgaagataaatgacaccggatccgccaccacggccaccactaccaccgcaactgaaactgaaatcaaacctaaggaggaagacgccaccccggctagtttgcaccaggatcactacttagtcccttataatcaaagagcaaaccactctaaacctatcccacctttccttttggatctagattcccagtctgttcccgatgctctgaagaagcaaacaaatgattattatattttatacaacccggcactaccaagagaaattgacgttgagttacacaaatctttggatcatacttcagttgtttgttgcgtgaagttcagtaacgatggtgaatacttagccacaggctgcaacaaaactactcaagtgtatcgcgtttcagatggttctctggtggcccgtctatctgacgattctgctgccaataaccatcgaaattcgatcactgaaaataacaccaccacgtccacggataacaatacaatgacaaccactactaccaccacaattactaccacagcgatgacttcggcagcagaattggcaaaagatgtggaaaacctgaacacttcgtcttccccatcatccgacttgtatatccgttcagtgtgtttttctccagatgggaaatttttggcaacaggtgctgaagacagactgattagaatttgggatattgaaaatagaaagattgttatgattcttcaaggccacgaacaagatatttattcattggactactttccctcaggtgacaaattagtctccggttctggtgaccgtaccgttcgtatttgggacttacgtacaggccagtgttcattgactttatccattgaagatggtgttaccaccgtcgctgtatcaccaggtgatggtaaatacatcgctgctggttctctagatcgtgctgtgagagtttgggattccgagaccggattcttggtggaaagactagattcggaaaacgaatccggtacaggccacaaggactctgtttatagcgttgtcttcactagagatggacaaagcgttgtatccggctcattagatagatctgttaagctctggaatttgcagaatgcaaacaacaagagcgattcgaaaactccaaattccggcacttgtgaagttacgtatatcgggcataaagactttgtattgtccgtggccaccacacaaaatgatgagtacatcttgtccggttccaaagatcgtggtgtcctgttttgggataagaaatccggcaatccgttattgatgttgcaaggtcataggaattcagttatatctgtggctgtggcaaacgggtctccgctgggtccagaatataacgtttttgctactggtagcggtgattgtaaagcaaggatttggaagtataaaaaaatagcgccaaattaa

SEQ ID NO: 137 - protein, 966 aa, Saccharomyces cerevisiae; identical to SEQ ID NO: 33

SEQ ID NO: 138 - protein, 713 aa, Saccharomyces cerevisiae
MTASVSNTQNKLNELLDAIRQEFLQVSQEANTYRLQNQKDYDFKMNQQLAEMQQIRNTVYELELTHRKMKDAYEEEIKHLKLGLEQRDHQIASLTVQQQRQQQQQQQVQQHLQQQQQQLAAASASVPVAQQPPATTSATATPAANTTTGSPSAFPVQASRPNLVGSQLPTTTLPVVSSNAQQQLPQQQLQQQQLQQQQPPPQVSVAPLSNTAINGSPTSKETTTLPSVKAPESTLKETEPENNNTSKINDTGSATTATTTTATETEIKPKEEDATPASLHQDHYLVPYNQRANHSKPIPPFLLDLDSQSVPDALKKQTNDYYILYNPALPREIDVELHKSLDHTSVVCCVKFSNDGEYLATGCNKTTQVYRVSDGSLVARLSDDSAANNHRNSITENNTTTSTDNNTMTTTTTTTITTTAMTSAAELAKDVENLNTSSSPSSDLYIRSVCFSPDGKFLATGAEDRLIRIWDIENRKIVMILQGHEQDIYSLDYFPSGDKLVSGSGDRTVRIWDLRTGQCSLTLSIEDGVTTVAVSPGDGKYIAAGSLDRAVRVWDSETGFLVERLDSENESGTGHKDSVYSVVFTRDGQSVVSGSLDRSVKLWNLQNANNKSDSKTPNSGTCEVTYIGHKDFVLSVATTQNDEYILSGSKDRGVLFWDKKSGNPLLMLQGHRNSVISVAVANGSPLGPEYNVFATGSGDCKARIWKYKKIAPN

SEQ ID NO: 139 - protein, 7 aa, Artificial Sequence
  part of vector insert
EWYLQLR

SEQ ID NO: 140 - protein, 25 aa, Pichia pastoris
MFEKSKFVVSFLLLLQLFCVLGVHG
